(12) United States Patent
Schultze et al.

(10) Patent No.: US 9,040,051 B2
(45) Date of Patent: *May 26, 2015

(54) MARKER GENES FOR REGULATORY T CELLS FROM HUMAN BLOOD

(75) Inventors: Joachim Ludwig Schultze, Königswinter (DE); Marc Daniel Beyer, Köln (DE); Noel Warner, Los Gatos, CA (US); Ravi Hingorani, San Diego, CA (US)

(73) Assignees: UNIVERSITAET ZU KOELN, Cologne (DE); BECTON DICKINSON AND COMPANY, Franklin Lakes, NJ (US)

(*) Notice: Subject to any disclaimer, the term of this patent is extended or adjusted under 35 U.S.C. 154(b) by 1221 days.

This patent is subject to a terminal disclaimer.

(21) Appl. No.: 12/681,263

(22) PCT Filed: Oct. 2, 2008

(86) PCT No.: PCT/EP2008/063245
§ 371 (c)(1),
(2), (4) Date: Dec. 22, 2010

(87) PCT Pub. No.: WO2009/043908
PCT Pub. Date: Apr. 9, 2009

(65) Prior Publication Data
US 2011/0097334 A1    Apr. 28, 2011

Related U.S. Application Data

(60) Provisional application No. 60/976,866, filed on Oct. 2, 2007.

(51) Int. Cl.
| | |
|---|---|
| *G01N 33/53* | (2006.01) |
| *C12N 5/071* | (2010.01) |
| *C07K 14/705* | (2006.01) |
| *C12N 5/0783* | (2010.01) |
| *C07K 16/28* | (2006.01) |
| *A61K 38/00* | (2006.01) |
| *A61K 39/00* | (2006.01) |

(52) U.S. Cl.
CPC ............... *C07K 14/705* (2013.01); *A61K 35/17* (2013.01); *A61K 38/00* (2013.01); *A61K 2039/5154* (2013.01); *A61K 2039/5158* (2013.01); *C12N 5/0636* (2013.01); *C12N 2501/23* (2013.01); *C12N 2501/24* (2013.01); *C12N 2501/51* (2013.01); *C12N 2501/515* (2013.01); *C12N 2502/11* (2013.01); *C12N 2799/027* (2013.01); *C07K 16/28* (2013.01)

(58) Field of Classification Search
None
See application file for complete search history.

(56) References Cited

U.S. PATENT DOCUMENTS 7,932,032 B2 * 4/2011 Akiyama et al. ............. 435/6.14
2003/0138865 A1 * 7/2003 MacBeth et al. ............. 435/7.23

FOREIGN PATENT DOCUMENTS

WO        03 046152 A2     6/2003
WO     2005 113812 A2    12/2005
WO    WO 2006118308 A1 * 11/2006

OTHER PUBLICATIONS

Hoffmann et al., 2004, Blood. vol. 104: 895-903.*
Liu et al., 2006, J. Exp. Med. vol. 203: 1701-1711.*
XP-002508037, Database EMBL, Feb. 26, 2002; Strausbert et al.; "Generation and initial analysis of more than 15,000 full length human and mouse cDNA sequences"; Proceedings of the National Academy of Sciences of USA, vol. 99, No. 26.
XP-002508038, Database EMBL, Apr. 26, 2005; Clark et al, "The secreted protein discovery initiative (SPDI), a large-scale effort to identify novel human secreted and transmembrane proteins: a bioinformatics assessment"; Jan. 1, 2003, Genome Research, Cold Spring Harbor Laboratory Press.
Fontenot et al; Foxp3 programs the development and function of CD4+CD25+ regulatory T cells; Nature Immunology, Nature Publishing Group, GB, vol. 4, No. 4, Apr. 1, 2003, pp. 330-336.
Deloukas, et al; "The DNA sequence and comparative analysis of human chromosome 10"; May 27, 2004, Nature May 27, 2004, vol. 429, No. 6990, pp. 375-381.
XP-002508039, Database EMBL, Jul. 24, 2007, Deloukas et al, "The DNA sequnce and comparative analysis of human chromosome 10"; Nature May 27, 2004, vol. 429, No. 6990.
Communication and Partial European Search Report dated Jan. 19, 2012.

* cited by examiner

*Primary Examiner* — Amy Juedes
(74) *Attorney, Agent, or Firm* — Norris McLaughlin & Marcus, P.A.

(57) ABSTRACT

The present invention provides novel marker genes for the specific identification and characterization of human suppressive and/or regulatory T cells including natural, adaptive, and expanded CD4+CD25+FOXP3+ T cells in healthy individuals as well as tumor patients or patients with autoimmune diseases.

2 Claims, 37 Drawing Sheets

MARKER GENES FOR REGULATORY T CELLS FROM HUMAN BLOOD

The present invention provides novel marker genes for the specific identification and characterization of human suppressive and/or regulatory T cells including natural, adaptive, and expanded CD4$^+$CD25$^+$FOXP3$^+$ T cells in healthy individuals as well as tumor patients or patients with autoimmune diseases.

BACKGROUND OF THE INVENTION

As early as 1971, a so-called "suppressor" cell population was first described by Gershon and Kondo when they transferred antigen-specific tolerance to naïve animals by transferring antigen-experienced T cells (Gershon and Kondo, Immunology; 21: 903-914 (1971)). Due to conflicting results the concept of T cell suppression however fell into oblivion in the late 1980s.

Sakaguchi et al. were the first to describe now termed "regulatory" T cells (T$_{reg}$ cells) by identifying a population of CD4$^+$ T cells highly expressing CD25 and preventing autoimmunity in a murine model (Sakaguchi et al., J. Immunol. 155: 1151-1164 (1995)). In the following years a number of reports enlightened major aspects of T$_{reg}$ cell biology, characterizing different T cell subpopulations with regulatory properties including naturally occurring CD4$^+$CD25$^{high}$ T$_{reg}$ cells, induced T$_{reg}$ cells, e.g. Tr1 and TH3 cells, as well as adaptive CD4$^+$CD25$^{high}$ T$_{reg}$ cells developing in the periphery by conversion of CD4$^+$CD25$^-$ T cells. All these different T cell populations with regulatory function coexist and contribute to immune suppression (Mills and McGuirk, Semin. Immunol.; 16: 107-117 (2004); Sakaguchi, Annu. Rev. Immunol.; 22: 531-562 (2004); Sakaguchi, Nat. Immunol.; 6: 345-352 (2005); Vigouroux et al., Blood; 104: 26-33 (2004)).

In the mouse CD25 is a good marker for T$_{reg}$ cells as animals are held under pathogen-free conditions. However, humans are constantly exposed to foreign antigens leading to a significant fraction of recently activated CD25$^+$ effector T cells. In search of more specific T$_{reg}$ cell markers, the transcription factor FOXP3 has been identified as uniquely expressed in T$_{reg}$ cells in the mouse (Fontenot et al., Nat. Immunol.; 4: 330-336 (2003); Hori et al., Science; 299: 1057-1061 (2003); Khattri et al., Nat. Immunol.; 4: 337-342 (2003)) and expression has been proposed as a lineage marker already in developing T$_{reg}$ cells (Bennett et al., Nat. Genet.; 27: 20-21 (2001); Brunkow et al., Nat. Genet.; 27: 68-73 (2001)).

However, caution about its specificity still is recommended as recent reports in humans demonstrated induction of FOXP3 in activated conventional T cells without suppressive activity (Allan et al., J. Clin. Invest.; 115: 3276-3284 (2005); Morgan et al., Hum Immunol; 66: 13-20 (2005); Walker et al., J Clin Invest; 112: 1437-1443 (2003)). Recently developed mouse models suggest that FOXP3 is mandatory for the suppressive function of T$_{reg}$ cells and the final establishment of a T$_{reg}$ cell phenotype while lineage commitment apparently is independent of FOXP3 expression (Lin et al., Nat. Immunol.; 8: 359-368 (2007); Wan and Flayell, Nature; 445: 766-770 (2007); Williams and Rudensky, Nat Immunol; 8: 277-284 (2007)).

Characteristics of CD4$^+$CD25$^{high}$FOXP3$^+$ T$_{reg}$ cells are their anergic state, their ability to actively inhibit CD4$^+$CD25$^-$ T cells, CD8$^+$ T cells, DC, NK, NKT, and B cells in a cell-cell contact and dose-dependent manner (Azuma et al., Cancer Res.; 63: 4516-4520 (2003); Chen, Front Biosci; 11: 1360-1370 (2006); Lim et al., J. Immunol.; 175: 4180-4183 (2005); Murakami et al., Proc. Natl. Acad. Sci. USA; 99: 8832-8837 (2002); Romagnani et al., Eur. J. Immunol.; 35: 2452-2458 (2005); Trzonkowski et al., Clin. Immunol.; 112: 258-267 (2004)). Phenotypically CD4$^+$CD25$^{high}$FOXP3$^+$ T$_{reg}$ cells are characterized as antigen-experienced memory T cells, although lately some reports have described naïve CD4$^+$CD25$^{high}$FOXP3$^+$ T cells in mice as well as humans (Beyer et al., Blood (2006); Valmori et al., J. Clin. Invest.; 115: 1953-1962 (2005)). Amongst the cell-surface markers associated with T$_{reg}$ cell phenotype and function cytotoxic T lymphocyte-associated protein 4 (CTLA4) and glucocorticoid-induced TNFR-related protein (GITR) are the most prominent molecules (McHugh et al., Immunity; 16: 311-323 (2002); Read et al., J. Exp. Med.; 192: 295-302 (2000); Shimizu et al., Nat. Immunol.; 3: 135-142 (2002); Takahashi et al., J. Exp. Med.; 192: 303-310 (2000)). Additionally, IL10 and TGFβ although rarely expressed in vitro might have functional importance for T$_{reg}$ cells in vivo, particularly in context of disease (Hara et al., J. Immunol.; 166: 3789-3796 (2001); Nakamura et al., J. Exp. Med.; 194: 629-644 (2001)). Major topics of current research are the characterization of T$_{reg}$ cell defects in autoimmune diseases and their role in infectious diseases and transplantation tolerance, particularly after allogeneic bone-marrow transplantation (Belkaid and Rouse, Nat. Immunol.; 6: 353-360 (2005); Hoffmann et al., Curr. Top Microbiol. Immunol.; 293: 265-285 (2005); Paust and Cantor, Immunol. Rev.; 204: 195-207 (2005); Sakaguchi, Annu Rev Immunol; 22: 531-562 (2004); Sakaguchi, Nat. Immunol.; 6: 345-352 (2005); Waldmann et al., Semin. Immunol.; 16: 119-126 (2004)). While research in T$_{reg}$ cell biology is intensifying, it is still unclear whether T$_{reg}$ cells in humans particularly in context of human diseases are mainly primed in the thymus or emerge in the periphery due to antigen-specific stimulation. The lack of more specific cell-surface markers is a major reason, why many functionally relevant aspects of T$_{reg}$ cells are still unknown.

T$_{reg}$ cells protect the host from autoimmune disease by suppressing self-reactive cells. As such, T$_{reg}$ cells may also block anti-tumor immune responses. Particularly in the context of cancer, T$_{reg}$ cell frequencies and function are important as increased numbers might favor tumor development or growth and influence the course of the disease. Currently a number of important questions are under intense investigation. Is the increase of T$_{reg}$ cell frequencies an early event at the onset of disease or more likely a response of the immune system during tumor progression? Do organ-specific and more important, do tumor-specific T$_{reg}$ cells play a role? How does therapy influence T$_{reg}$ cell numbers, particularly in already established tumors? Is there a possibility of long-term depletion of T$_{reg}$ cells and is this connected to induction of autoimmunity?

A number of mouse models could establish the development of T$_{reg}$ cells during tumor progression (Peng et al., J. Immunol.; 169: 4811-4821 (2002)). Relatively early induction of T$_{reg}$ cells during tumor development has significant impact in human disease as the time point of T$_{reg}$ cell induction in cancer patients certainly precedes the time of diagnosis in the majority of patients. Furthermore, a suppressive effect of naturally occurring T$_{reg}$ cells against tumor-specific CD8$^+$ T cells was established in a poorly immunogenic B16 melanoma model (Turk et al., J. Exp. Med.; 200: 771-782 (2004)). Further evidence for the interference of T$_{reg}$ cells with CD8$^+$ T cell-mediated anti-tumor immune responses in vivo was established in a transgenic murine colon carcinoma model where T$_{reg}$ cells abrogated CD8$^+$ T cell-mediated tumor rejection by specifically suppressing cytotoxicity of CTL (Chen et al., Proc. Natl. Acad. Sci. USA; 102: 419-424 (2005)).

It has been suggested that suppression of anti-tumor immunity by $T_{reg}$ cells occurs predominantly at the tumor site and that local reversal of suppression, even late during tumor development, can be an effective treatment (Yu et al., J. Exp. Med.; 201: 779-791 (2005)).

Analysis of tumor-draining LN demonstrated that both anti-tumor effector T cells and FOXP3$^+$ $T_{reg}$ cells are primed in the same LN during tumor progression. These tumor-antigen specific $T_{reg}$ cells possessed the same functional properties as $T_{reg}$ cells that arise naturally in the thymus (Hiura et al., J. Immunol.; 175: 5058-5066 (2005)).

Already before the identification of CD4$^+$CD25$^+$ $T_{reg}$ cells early data indicated that non-specific depletion of CD4$^+$ T cells can lead to the induction of efficient anti-tumor immunity (Fu et al., Int. J. Cancer; 87: 680-687 (2000)). More specifically targeting $T_{reg}$ cells by administration of CD25 mAb abrogated immunological unresponsiveness to tumors and induced spontaneous development of tumor-specific CD8$^+$ effector T cells and NK cells (Shimizu et al., J. Immunol.; 163: 5211-5218 (1999)). Interestingly, depletion of $T_{reg}$ cells led to cross-reactive tumor immunity against tumors of diverse origins (Golgher et al., Eur. J. Immunol; 32: 3267-3275 (2002)). Timing of $T_{reg}$ cell elimination also seems to be an important aspect. Administration of CD25 mAb later than 2 days after inoculation of myeloma cells caused no tumor regression, irrespective of $T_{reg}$ cell depletion (Onizuka et al., Cancer Res; 59: 3128-3133; (1999)). As already outlined this might be due to the induction of anti-tumor tolerance at a relatively early time-point of tumor development resulting in inefficient activation of effector cells. Furthermore the number of $T_{reg}$ cells after CD25 depletion is restored over time and the capacity to mount an anti-tumor response progressively diminishes (Casares et al., J. Immunol.; 171: 5931-5939 (2003)).

Depletion of $T_{reg}$ cells together with other immunostimulatory approaches, e.g. CTLA4 blockade, has also been tested. Combination of $T_{reg}$ cell depletion and CTLA4 blockade was synergistic and resulted in maximum tumor rejection. The observed synergism indicates that both pathways represent two alternatives for suppression of auto-reactive T cells so that simultaneous intervention might be a promising concept for the induction of therapeutic anti-tumor immunity (Sutmuller et al., J. Exp. Med; 194: 823-832 (2001)). Since immune responses to malignant tumors often are weak and ineffective, solely depleting $T_{reg}$ cells might not always result in tumor regression. Approaches combining $T_{reg}$ cell depletion with other immunological interventions, e.g. transfer of activated T cells or DC-based vaccinations, therefore might be more beneficial (Prasad et al., J. Immunol.; 174: 90-98 (2005); Tanaka et al., J. Immunother; 25: 207-217 (2002); Van Meirvenne et al., Mol. Ther.; 12: 922-932 (2005)).

It has long been recognized that cyclophosphamide exerts an immunostimulatory effect (Greenberg et al., J. Exp. Med.; 154: 952-963 (1981)). Early data indicated that cyclophosphamide preferentially destroys CD4$^+$ suppressor T cells causing immunologically mediated regression of immunogenic lymphomas in mice (Awwad and North, Cancer Res.; 49: 1649-1654 (1989)). In a rat colon cancer model administration of cyclophosphamide depleted $T_{reg}$ cells and delayed the outgrowth of tumors (Ghiringhelli et al., Eur. J. Immunol.; 34: 336-344 (2004)). Combining cyclophosphamide and immunotherapy even cured the mice, while both strategies applied alone had no curative effect (Ercolini et al., J. Exp. Med.; 201: 1591-1602 (2005); Ghiringhelli et al., Eur. J. Immunol.; 34: 336-344 (2004)). Low-dose cyclophosphamide not only decreases numbers of $T_{reg}$ cells but also leads to decreased function, enhanced apoptosis and decreased homeostatic proliferation (Lutsiak et al., Blood; 105: 2862-2868 (2005)). This suggests that cyclophosphamide might be successfully integrated into chemoimmunotherapy as recently shown by Dudley et al. in Science; 298: 850-854 (2002). The combination of adoptive transfer of ex vivo activated tumor-specific T cells to lymphopenic melanoma patients after chemotherapy with cyclophosphamide and fludarabine induced tumor regression in up to 50% of patients treated.

Since $T_{reg}$ cells are an important cellular mechanism suppressing auto-antigen specific conventional T cells from attacking self tissues, non-specific depletion of these cells might be a too crude approach to be used without leading to significant collateral damage. The fine balance between benefit and harm of manipulating $T_{reg}$ cells was elegantly demonstrated in the following experiment: transfer of a mixture of CD4$^+$CD25$^-$ and CD4$^+$CD25$^+$ T cells prevented effective adoptive immunotherapy of established melanoma. In contrast, adoptive transfer of CD4$^+$CD25$^-$ T cells together with tumor—as well as self-reactive CD8$^+$ T cells into CD4$^+$ T cell deficient hosts followed by vaccination induced both regression of established melanoma but also severe and undesired autoimmunity (Antony et al., J. Immunol.; 174: 2591-2601 (2005)). Similarly, depletion of $T_{reg}$ cells with CD25 mAb in a mammary gland tumor model resulted in tumor regression but significantly increased susceptibility to autoimmune thyroiditis. This in vivo priming to both tumor- and self-antigens attests to the presence of otherwise undetectable immune effectors which are under negative regulation and demonstrates that modulation of $T_{reg}$ cells is a powerful strategy in cancer therapy, but may also significantly increase autoimmune complications (Wei et al., Cancer Res.; 65: 8471-8478 (2005); Wei et al., Cancer Immunol. Immunother.; 53: 73-78 (2004)).

Human Regulatory T Cells in Cancer—Current Knowledge and Open Questions

Already in the early 1990s T cells with regulatory function were reported in cancer patients, however, these reports were not followed up until the identification of CD4$^+$CD25$^+$ $T_{reg}$ cells in the mid 1990s (Sakaguchi et al., J. Immunol.; 155: 1151-1164 (1995)). Since then, an increase of $T_{reg}$ cells in cancer patients has been reported by numerous investigators. In contrast to the murine system, definition of human $T_{reg}$ cells has been more difficult and assessment of the most specific marker, namely FOXP3 has not been performed in many of the early studies. While human CD4$^+$CD25$^{high}$ T cells are most enriched for FOXP3$^+$ T cells, there are still significant numbers of FOXP3$^+$ cells within the CD4$^+$CD25$^{low}$ T cell population. In absence of more specific cell-surface markers, it is not yet possible to study human FOXP3$^+$ $T_{reg}$ cells irrespective of their CD25 expression. These limitations also explain why $T_{reg}$ cells in humans currently need to be characterized by a combination of FOXP3 and CD25 expression as well as analysis of inhibitory function of T cell populations enriched for FOXP3$^+$ cells, mainly by sorting CD25$^{high}$ T cells.

Comparability of previous reports is further challenged by use of different antibodies to detect CD25 or different gating strategies when assessing CD25$^+$/CD25$^{high}$ cells. Similarly, function of $T_{reg}$ cells has been assessed with numerous in vitro approaches making it rather difficult to compare results of different studies.

Woo et al. were the first to report increased percentages of CD4$^+$CD25$^+$ $T_{reg}$ cells in TIL in non-small cell lung cancer and ovarian cancer (Woo et al., Cancer Res.; 61: 4766-4772; (2001)). These $T_{reg}$ cells were shown to secret TGFβ providing first evidence that $T_{reg}$ cells contribute to immune dysfunction in cancer patients (Woo et al., Cancer Res; 61: 4766-4772; (2001)). Further characterization of these cells showed constitutive high-level expression of CTLA-4. More important, $T_{reg}$ cells mediated potent inhibition of T cell proliferation (Woo et al., J. Immunol.; 168: 4272-4276 (2002)). Supporting this initial report, a larger study concluded that prevalence of $CD4^+CD25^+$ $T_{reg}$ cells is increased not only in the tumor microenvironment of patients with invasive breast or pancreas cancers but also in PB, suggesting that the increase of $T_{reg}$ cells is a generalized phenomenon (Liyanage et al., J. Immunol.; 169: 2756-2761 (2002)).

In malignant melanoma an increase of functional $CD4^+$ $CD25^+$ $T_{reg}$ cells was observed (Javia and Rosenberg, J. Immunother.; 26: 85-93 (2003)), which was further linked to increases in the serum level of H-Ferritin (Gray et al., Clin. Cancer Res.; 9: 2551-2559 (2003)).

In patients with gastrointestinal malignancies the relative increase of $T_{reg}$ cells might actually be explained by a significant reduction of $CD4^+CD25^-$ T cells. Interestingly, in patients with gastric carcinoma poor prognosis and decreased survival rates were closely correlated with higher $T_{reg}$ cell frequencies (Ichihara et al., Clin. Cancer Res.; 9: 4404-4408 (2003); Sasada et al., Cancer; 98: 1089-1099 (2003)). After curative resections, previously elevated $T_{reg}$ cells numbers were significantly reduced. In contrast, prevalence of $T_{reg}$ cells increased again in patients relapsing after tumor resection (Kono et al., Cancer Immunol. Immunother.; 1-8 (2005)). These findings underline the close correlation of tumor growth and $T_{reg}$ cell frequencies.

Curiel et al. demonstrated that $CD4^+CD25^+FOXP3^+$ $T_{reg}$ cells suppress tumor-specific T cell immunity in ovarian cancer, contribute to tumor growth, and accumulate during progression (Curiel et al., Nat. Med.; 10: 942-949 (2004)). Furthermore, increased frequencies of $T_{reg}$ cells were associated with a high death hazard ratio and reduced survival. $T_{reg}$ cells preferentially moved to and accumulated in tumors and ascites, but rarely entered draining LN in later cancer stages. Tumor cells and surrounding macrophages produced the chemokine CCL22, which mediated trafficking of $T_{reg}$ cells to the tumor via CCR4. This specific recruitment of $T_{reg}$ cells might represent a mechanism by which tumors may foster immune privilege.

For patients with squamous cell carcinoma of the head and neck a significantly elevated frequency of $FOXP3^+GITR^+$ $T_{reg}$ cells was shown (Schaefer et al., Br. J. Cancer; 92: 913-920 (2005)). These $T_{reg}$ cells were significantly more sensitive to apoptosis than non-$T_{reg}$ cells which might hint at a rapid turnover in the peripheral circulation (Schaefer et al., Br. J. Cancer; 92: 913-920 (2005)). How the higher sensitivity to apoptosis influences $T_{reg}$ cells frequencies however has not been addressed yet.

Increased numbers of $T_{reg}$ cells have also been reported in PB and TIL of patients with hepatocellular carcinoma (Ormandy et al., Cancer Res.; 65: 2457-2464 (2005)). While the increase of $T_{reg}$ cells seems to be a common theme in solid tumors, there are clear but yet unexplained differences between individual tumor entities. In a comparative study differences in $T_{reg}$ cell frequencies were shown for malignant pleural effusions from patients with mesothelioma compared to carcinomatous pleural effusions from non-small cell lung cancer or breast cancer patients (DeLong et al., Cancer Biol. Ther.; 4: 342-346 (2005)).

Overall, previous work has clearly established that $T_{reg}$ cells are increased in most human solid tumors. Furthermore, there seems to be a stage dependent increase of $T_{reg}$ cells with frequencies of $T_{reg}$ cells probably correlated to overall survival. However, little is known about the mechanisms leading to this increase. A first study by Wolf et al. might help us to understand the underlying molecular mechanisms (Wolf et al., Cancer Immunol. Immunother.; 1-11 (2005)). In this study it was shown that increased frequencies of $T_{reg}$ cells in PB of cancer patients are due to active proliferation rather than redistribution from other compartments (i.e. secondary lymphoid organs or bone marrow). This finding in combination with the proposed attraction of $T_{reg}$ cells to the tumor via CCL22/CCR4 and induction of $T_{reg}$ cells by $PGE_2$ or H-Ferritin might be one possible mechanism responsible for expansion of $T_{reg}$ cells in cancer patients.

While the question of $T_{reg}$ cells in solid tumors sparked interest relatively early, studies addressing $T_{reg}$ cells in hematological malignancies have been conducted only recently.

In patients with B cell chronic lymphocytic leukemia (CLL) a stage dependent increase of $CD4^+CD25^{high}FOXP3^+$ $CTLA4^+GITR^+$ $T_{reg}$ cells with full suppressive capacity could be established. However, when CLL patients were treated with fludarabine frequencies of $T_{reg}$ cells decreased and $T_{reg}$ cells showed impaired function. Ongoing studies are addressing the question how fludarabine mediates this effect (Beyer et al., Blood; 106: 2018-2025 (2005)). The increase of $CTLA4^+$ $T_{reg}$ cells in untreated CLL patients which correlated with advanced disease stage and unfavorable cytogenetics was recently confirmed by others (Motta et al., Leukemia; 19: 1788-1793 (2005)). Similarly, in patients with B cell non-Hodgkin's lymphomas (B-NHL) increased frequencies of $FOXP3^+CTLA4^+$ $T_{reg}$ cells have been observed. PD1 expression was partly responsible for the suppressive activity of these LN infiltrating $T_{reg}$ cells. Furthermore, as reported for ovarian cancer, the tumor cells released CCL22 and thereby attracted $CCR4^+$ $T_{reg}$ cells into the area of the lymphoma (Yang et al., Blood (2006)). For patients with acute myeloid leukemia (AML) higher frequencies of $CD4^+CD25^{high}$ $T_{reg}$ have been observed. Similar to observations in solid tumors, $T_{reg}$ cells of AML patients were less resistant to apoptosis but showed higher proliferation compared to healthy individuals (Wang et al., Eur. J. Haematol.; 75: 468-476 (2005)).

Comparable to other hematological malignancies, increased frequencies of $CD4^+CD25^{high}FOXP3^+$ $T_{reg}$ cells in patients with monoclonal gammopathy of undetermined significance (MGUS) or multiple myeloma (MM) could be demonstrated (Beyer et al., Blood (2006)). Independent of prior therapy or stage of disease $T_{reg}$ cells exhibited a strong inhibitory capacity. Moreover, the increase of $T_{reg}$ cells was also stage-dependent and resulted from peripheral expansion. Furthermore, an expansion of naïve $CD4^+CD25^{high}FOXP3^+$ $T_{reg}$ cells co-expressing CD45RA and CCR7 could be established for the first time further supporting the concept of peripheral expansion of this T cell compartment. The importance of identifying more specific markers as well as more standardized functional assays is supported by a recent report on $FOXP3^+$ cells in PB from MM patients (Prabhala et al., Blood; 107: 301-304 (2006)). Due to an alternative experimental approach only assessing FOXP3 in context of $CD4^+$ T cells but not $CD25^+$ cells these data are difficult to compare with other studies on naturally occurring $CD4^+CD25^{high}$ $T_{reg}$ cells. While this report came to the conclusion that $T_{reg}$ cells are dysfunctional in MM patients, the assays chosen to assess $T_{reg}$ cell function allowed for alternative explanations of the observed results including already described defects in conventional autologous T cells in MM patients (Mariani et al., Br. J. Haematol.; 113: 1051-1059 (2001)). To reconcile these recent findings about $T_{reg}$ cells it is most important to identify specific cell-surface markers for T$_{reg}$ cells that allow us to isolate these cells and functionally test them in context of malignant disease.

Taken together the concept of increased T$_{reg}$ cells has been established for solid tumors as well as hematological malignancies. However, more specific markers such as FOXP3 as well as more sophisticated and standardized functional assays have to be developed.

As already outlined a correlation of increased T$_{reg}$ cells with greater disease burden and poorer overall survival has been reported. In CLL reduced frequencies of functionally impaired T$_{reg}$ cells after fludarabine treatment could be observed, however not every chemotherapeutic agent seems to induce this effect as in CLL or MM no other treatment including autologous stem cell transplantation did induce similar effects. In line with this observation, frequency and suppressive function of T$_{reg}$ cells in tumor-draining LN derived from cervical cancer patients were not influenced by chemotherapy or combined chemoradiation (Fattorossi et al., Cancer; 100: 1418-1428 (2004)).

Recent work has demonstrated that IL2 signaling is required for thymic development, peripheral expansion and suppressive activity of T$_{reg}$ cells (Malek and Bayer, Nat. Rev. Immunol.; 4: 665-674 (2004)). During immune reconstitution after chemotherapy IL2 therapy led to a homeostatic peripheral expansion of T$_{reg}$ cells and to a markedly increased T$_{reg}$ cell compartment. IL2 therapy induced expansion of existent T$_{reg}$ cells in normal hosts and this expansion was further augmented by lymphopenia. T$_{reg}$ cells generated by IL2 therapy expressed FOXP3 at levels observed in healthy individuals and these T$_{reg}$ cells also were of similar potency suggesting that IL2 and lymphopenia are modulators of T$_{reg}$ cell homeostasis (Zhang et al., Nat. Med.; 11: 1238-1243 (2005)). Similarly, in patients with melanoma or renal cell carcinoma (RCC) the frequency of fully functional T$_{reg}$ cells was significantly increased after IL2 treatment, which was also accompanied by an increase of FOXP3 demonstrating that administration of high dose IL2 increases the frequency of circulating FOXP3$^+$ T$_{reg}$ cells (Ahmadzadeh and Rosenberg, Blood (2005)). This might also explain why therapy with IL2 in RCC patients has not yet fully lived up to expectations since significant induction of T$_{reg}$ cells might counteract potential anti-tumor effects of IL2.

Surprisingly, vaccination of melanoma patients with DC either loaded with synthetic peptides or tumor lysates was also shown to induce increased frequencies of T$_{reg}$ cells, concomitant with the expansion of tumor-specific CTL. Whether this enhances anti-tumor tolerance and negatively influences the induction of clinically efficient anti-tumor immune responses needs further attention, since the mechanisms of this phenomenon are not yet understood (Chakraborty et al., Hum. Immunol.; 65: 794-802 (2004)).

Murine models have established that selective elimination of T$_{reg}$ cells alone or in combination with other treatment options might induce regression of already established tumors. First pilot studies have been initiated in cancer patients to selectively eliminate T$_{reg}$ cells. A promising and specific approach might be targeting of CD25 on the surface of T$_{reg}$ cells. Danull et al. used IL2 diphtheria toxin conjugate DAB(389)IL2 (denileukin diftitox, ONTAK) to selectively eliminate CD25-expressing T$_{reg}$ cells from the PBMC of cancer patients without inducing toxicity on other cells that only expressed CD25 at intermediate to low levels (Dannull et al., J. Clin. Invest.; 115: 3623-3633 (2005)). DAB(389)IL2 significantly reduced the number of T$_{reg}$ cells present in the PB of metastatic RCC patients and abrogated T$_{reg}$ cell mediated immunosuppressive activity in vivo. Moreover, elimination of T$_{reg}$ cells followed by vaccination with RNA-transfected DC significantly improved stimulation of tumor-specific T cell responses when compared with vaccination alone.

In summary, this first clinical study specifically eliminating T$_{reg}$ cells has shown promising results that need to be further evaluated. An important aspect of future studies will be to clearly describe the therapeutic window of deleting T$_{reg}$ cells as a major gate-keeper of self-antigen recognition.

In humans characterization of T$_{reg}$ cells has mainly focused on co-expression of CD4 and CD25 while differentiation status, frequencies of T$_{reg}$ cell subtypes, e.g. natural or induced T$_{reg}$ cells, Tr1 or TH3 cells are less well characterized. To better understand and study T$_{reg}$ cell biology in relation to tumor development and progression, it is most critical to identify more specific cell-surface markers as assessment of FOXP3 does not allow for subsequent functional testing of FOXP3$^+$ cells.

Using whole genome transcription analysis 43 candidate genes were identified, which might serve as diagnostic as well as therapeutic targets for future clinical studies. Among these candidate genes six transcripts were further specified that were up to now only described as putatively expressed protein products and that were found specific for human T$_{reg}$ cells.

SUMMARY OF THE INVENTION

The present invention provides (1) suppressive and/or regulatory human T cells expressing at least one marker protein comprising a sequence selected from the group consisting of SEQ ID NOs:2, 4, 6, 8, 10, 12, 14, 16, 18, 20, 22, 24, 26, 28, 30, 32, 34, 36, 38, 40, 42, 44, 46, 48, 50, 52, 54, 56, 58, 60, 62, 64, 66, 68, 70, 72, 74, 76, 78, 80, 82, 84, 86, 88, 90, 92, 94, 96, 98, 100, 102, 104, 106, 108, 110, 112, 114, 116, 118, 120, 122, 735 and muteins, derivatives or fragments thereof;

(2) a preferred embodiment of (1) above, wherein the T cells express at least one marker protein comprising a sequence selected from the group consisting of SEQ ID NO:2, 4, 8, 10, 12, 14 (said marker proteins being hereinafter shortly referred to as "Cologne 1 to 6" or "Col 1-6", respectively) and muteins, derivatives and fragments thereof;

(3) a method for expanding human T cells as defined in (1) or (2) above, which method comprises stimulating the cells with a T cell stimulating agent or with antigen-presenting cells;

(4) expanded human T cells obtainable by the method as defined in (3) above; (5) the use of human T cells as defined in (1), (2) or (4) above for preparing a regulatory medicament, a medicament for adoptive transfer therapy, a medicament for treating diseases with enhanced immunity including but not limited to autoimmune diseases, or a medicament for preventing/treating transplantation reactions such as graft versus host disease, graft rejections, etc;

(6) the use of human T cells as defined in (1), (2) and (4) above (a) in assays that will allow to identify other growth and/or functionally modifying (inhibitory/enhancing)/apoptotic or anti-apoptotic factors, (b) for identifying molecules expressed by the T cells as defined in (1), (2) and (4) above including identification of novel molecules said cells, or if presenting molecules which are deemed pharmaceutically active, or (c) for identifying precursor cells or progeny of the T cells as defined in (1), (2) and (4) above;

(7) a method for preparing T cells as defined in (1), (2) and (4) above having a particular desired antigen-specific T cell receptor which comprises
  (i) activating/stimulating/expanding the cells as defined in (1), (2) and (4) above with antigen presenting cells, preferably immature or mature dendritic cells (DC), presenting said antigen in vitro or in vivo; or
  (ii) utilizing a ligand/antibody to a particular T cell receptor expressed on (subsets of) cells as defined in (1), (2) and (4) above, or a MHC-peptide complex binding to a particular T cell receptor on (subsets of) CD4$^+$CD25$^+$ T cells;

(8) human T cells as defined in (1), (2), or (4) above which are obtainable by the method of (7) above;

(9) a pharmaceutical composition or medicament comprising the human T cells as defined in (1), (2), (4) or (8) above;

(10) a protein characteristic for human suppressive and/or regulatory T cells comprising a sequence selected from SEQ ID NOs: 2, 4, 10, 12, 14, 38, 60, 62, 64, 78, 80, 94 and 736 and muteins, derivatives and fragment thereof;

(11) a DNA sequence encoding the protein of (10) above;

(12) an expression constructs comprising the DNA sequence of (11) above;

(13) a host cell transformed/transfected with the expression construct of (12) above and/or comprising the DNA sequence of (11) above:

(14) a method for preparing the protein of (10) above which comprises culturing a transformed host cell of (13) above and isolating the protein from the cells and/or the culture broth;

(15) an antibody or antibody fragment binding to one or more of the proteins as defined in (10) above;

(16) a pharmaceutical or diagnostic composition comprising the antibody of (15) above;

(17) a method for isolating, identifying or characterizing suppressive and/or regulatory human T cells, which method comprises contacting a cell population (e.g. as obtained from human blood or cell culture) with one or more ligands that specifically bind to one or more marker proteins as defined in (1) or (2) above,

(18) a method for isolating, identifying or characterizing suppressive and/or regulatory human T cells obtained from human blood, comprising:
  (a) contacting the cells obtained from human blood with one or more ligands that specifically bind to one or more marker proteins as defined in (1) or (2) above, and
  (b) isolating, identifying or characterizing the suppressive and/or regulatory human T cells from the human blood;

(19) a kit for isolating, identifying or characterizing suppressive and/or regulatory human T cells comprising one or more ligands that specifically bind to one or more marker proteins as defined in (1) or (2) above, said kit being particularly useful for performing the method of (17) or (18) above;

(20) the use of the antibody or antibody fragment as defined in (15) above or an antibody/antibody fragment binding to the protein as defined in (1) or (2) above to isolate or characterize cells expressing the protein as defined in (1), (2) or (10) above including the suppressive and/or regulatory human T cells as defined in (1) above, or for preparing a medicament for enhancing or blocking the regulatory function of the protein as defined in (1), (2) or (10) above;

(21) a cell expressing the protein as defined in (1), (2) or (10) above or being generated by activation with an antigen presenting cell that has been pulsed with a protein as defined in (1), (2) or (10) above, or a peptide fragment thereof which binds to a major histocompatibility complex molecule;

(22) a preferred embodiment of (21) above, wherein the cell is a T cell, cytotoxic T cell or dendritic cell;

(23) the use of a cytotoxic T cells as defined in (22) above, which kill cells that express a protein as defined in (1), (2) or (10) above in a specific, major histocompatibility complex-restricted fashion, or an antigen-presenting cell of (8) above, which activates in-vivo a cytotoxic lymphocyte that kills cells that express a protein as defined in (1), (2) or (10) above, in a specific, major histocompatibility complex-restricted fashion, for preparing a medicament for treating patients that comprise or are at risk of comprising cells that express a protein as defined in (1), (2) or (10) above;

(24) the use of a peptide fragment of the protein as defined in (1), (2) or (10) above, which binds to a major histocompatibility complex molecule and is processed in vivo by an antigen presenting cell, which activates cytotoxic T cells which kill cells that express a protein as defined in (1), (2) or (10) above in a specific, major histocompatibility complex-restricted fashion, for preparing a medicament for treating patients that comprise or are at risk of comprising cells that express a protein as defined in (1), (2) or (10) above;

(25) the use of a DNA sequence as defined in (11) above, or a DNA sequence encoding the protein as defined in (1) or (2) above for preparing a medicament for treating a patient that comprises or is at risk of comprising cells that express a protein as defined in (1), (2) or (10) above;

(26) a method for adoptive transfer therapy which comprises injecting/infusing back into the patients enriched/expanded autologous or non-autologous cells as defined in (1), (2), (4) and (8) above, to prevent or treat any immune reactions that are too strong and/or pathogenic, or to prevent/treat transplantation reactions such as graft versus host disease and graft rejections;

(27) a method of treating patients that comprises or is at risk of comprising cells that express a (first) protein as defined in (1), (2) or (10) above, said method comprising administering to said patient cytotoxic T cells as defined in (22) above that kill said cells in a specific, major histocompatibility complex-restricted fashion;

(28) a preferred embodiment of (27) above, which further comprises administering to said patient cytotoxic T cells as defined in (22) above that kill cells in said patient that express a second protein as defined in (1), (2) or (10) above;

(29) a method of treating a patient that comprises or is at risk of comprising cells that express a protein as defined in (1), (2) or (10) above, said method comprising administering to said patient an antigen presenting cell that activated in said patient cytotoxic lymphocytes that kill said cells that express the protein as defined in (1), (2) or (10) above in a protein specific, major histocompatibility complex-restricted fashion; and

(30) a method of treating a patient that comprises or is at risk of comprising cells that express a protein as defined in (1), (2) or (10) above, said method comprising administering to said patient a DNA sequence as defined in (11) above, or a DNA sequence encoding a protein as defined in (1) or (2) above, wherein said nucleic acid molecule is expressed in said patient so that the polypeptide or peptide it encodes can be processed by an antingen presenting cell in said patient, which activates a cytotoxic T cell in said patient to kill said cell that express the protein as defined in (1), (2) or (10) above, in a protein specific, major histocompatibility complex-restricted fashion.

BRIEF DESCRIPTION OF THE FIGURES

FIG. 11: Maps of the pTrcHis-TOPO vector including the 6 genes with stop-codon.

FIG. 12: Maps of the pTrcHis-TOPO vector including the 6 genes without stop-codon.

FIG. 13: Maps of the pENTR4-eGFP vector including the 6 genes without stop-codon.

FIG. 14: Maps of the pLenti4/V5-DEST vector including the 6 genes without stop-codon.

FIG. 15: Maps of the pCDNA6-HisA vector including the 6 genes without stop-codon.

DETAILED DESCRIPTION OF THE INVENTION

Figure 1:
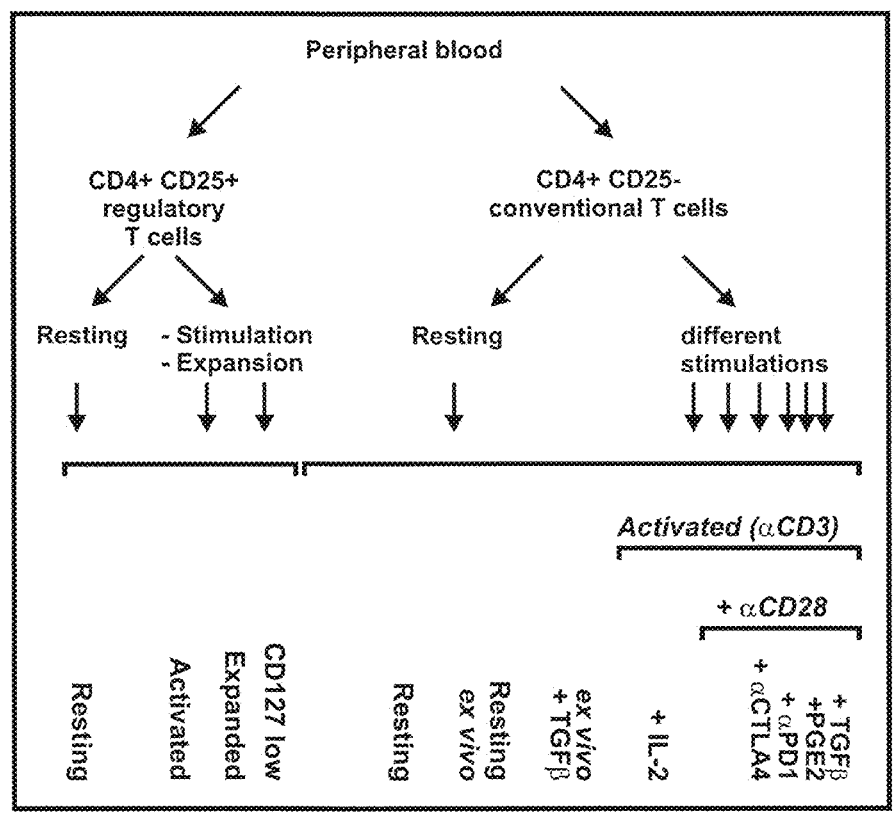
FIG. 1: Overview of the study to identify genes of Example 1

Aspects (1) and (2) of the invention relate to suppressive and/or regulatory T cells expressing at least one specific marker protein. The following describes methods and steps necessary to identify $T_{reg}$ cell specific genes. It starts with the description of the donors and the different isolation strategies to purify CD4$^+$CD25$^{high}$ regulatory T cells, conventional CD4$^+$CD25$^-$ T cells as well as the inclusion of CD127 in a second strategy to isolate $T_{reg}$ cells and conventional CD4$^+$ CD127$^+$CD25$^{low}$ T cells. Furthermore the in vitro culture conditions for stimulation of the different cell population is depicted, followed by a protocol to prepare cRNA samples for microarray hybridization, including a short description of the analysis methods used.

Using this bioinformatical approach lead to the identification of in total 43 genes (out of which genes 6 were elected and further tested) that are specifically expressed in human $T_{reg}$ cells. These genes are the following (hereinafter said genes and the proteins encoded thereby are referred to as "genes of the invention" and "proteins of the invention"):

FANK1:

Human FANK1 (fibronectin type III and ankyrin repeat domains 1; hereinafter also referred to as "Cologne 1" or "Col1") is located in the 127575098-127688151 genomic region on chromosome 10 in the 10q26.2 region. It consists of 11 exons resulting after transcription in an mRNA which has 1395 base pairs (see SEQ ID NO:1). The actual coding sequence itself consists of 1038 base pairs. The translation of this sequence results in a putative protein with a length of 346 amino acids (SEQ ID NO:2).

The protein was screened for functional domains and Cologne 1 has a fibronectin type 3 domain in the 9-94 region, which is one of three types of internal internal repeats found in the plasma protein fibronectin possibly related to extracellular secretion and localization of fibronectin as well as 5 ankyrin repeat domains in the 109-139, 143-172, 176-205, 209-238, 243-273, 277-306 regions, which mediate protein-protein interactions in very diverse families of proteins. Transmembrane domain prediction with an online transmembrane domain prediction server "DAS" lidentified 3 potential transmembrane regions (206-208, 222, 322-324). The putative protein has high homology (>88%) to the putative protein sequences of FANK1 described for mouse and rat. Expression analysis in different tissues demonstrated only low levels or absent expression of Cologne 1 in all tissues analyzed, including bone marrow, liver, heart, spleen, lung, kidney, thymus, skeletal muscle, brain, spinal cord, prostate, and pancreas.

Suitable MHC fragments/ligands of polypeptides can be determined according to Rammensee et al. (Rammensee et al., Immunogenetics; 41: 178-228 (1995)) and the database SYFPEITHI (Rammensee et al., Immunogenetics; 50: 213-219 (1999)).

In view of the continuously increasing number of motifs, it was necessary to set up a database which facilitates the search for peptides and allows the prediction of T-cell epitopes. The prediction is based on published motifs (pool sequencing, natural ligands) and takes into consideration the amino acids in the anchor and auxiliary anchor positions, as well as other frequent amino acids. The score is calculated according to the following rules: The amino acids of a certain peptide are given a specific value depending on whether they are anchor, auxiliary anchor or preferred residue. Ideal anchors will be given 10 points, unusual anchors 6-8 points, auxiliary anchors 4-6 and preferred residues 1-4 points. Amino acids that are regarded as having a negative effect on the binding ability are given values between −1 and −3. As far as T-cell epitopes are concerned, only those have been selected which are likely to be naturally processed.

Particular MHC ligands of Cologne 1 are shown in SEQ ID NOs:152-255.

PLEKHK1:

Human PLEKHK1 (pleckstrin homology domain containing, family K member 1, also known as rhotekin-2; hereinafter also referred to as "Cologne 2" or "Col2"), is located in the 63698472-63622959 genomic region on chromosome 10 in the 10q21.2 region. It consists of 12 exons resulting after transcription in an mRNA which has 6659 base pairs (see SEQ ID NO:3, a further variant thereof having 2123 base pairs being shown in SEQ ID NO:5). The actual coding sequence itself consists of 1830 base pairs. The translation of this sequence results in a putative protein with a length of 609 amino acids (SEQ ID NO:4).

Cologne 2 encodes a protein highly homologous to the human Rho-GTPase effector protein, rhotekin. Rhotekin belongs to the Class1 of Rho effector proteins, as well as PKN and rhophilin (Collier et al., Biochem. Biophys. Res. Commun.; 324: 1360-1369 (2004)).

The protein was screened for functional domains and Cologne 2 has a Pleckstrin homology (PH) domain in the 295-391 region, which are often involved in targeting proteins to the plasma membrane, but few display strong specificity in lipid binding. Any specificity is usually determined by loop regions or insertions in the N-terminus of the domain, which are not conserved across all PH domains. PH domains are found in cellular signaling proteins such as serine/threonine kinase, tyrosine kinases, regulators of G-proteins, endocytotic GTPases, adaptors, as well as cytoskeletal associated molecules and in lipid associated enzymese. Cologne 2 additionally has a Rho effector or protein kinase C-related kinase homology region 1 homologues domain in the 19-95 region, which was first described as a three times repeated homology region of the N-terminal noncatalytic part of protein kinase PRK1(PKN). The first two of these repeats were later shown to bind the small G protein rho known to activate PKN in its GTP-bound form. Similar rho-binding domains also occur in a number of other protein kinases and in the rho-binding proteins rhophilin and rhotekin. Recently, the structure of the N-terminal REM repeat complexed with RhoA has been determined by X-ray crystallography. It forms an antiparallel coiled-coil fold termed an ACC finger. Transmembrane domain prediction with an online transmembrane domain prediction server "DAS" identified 4 potential transmembrane regions (41-44, 197-199, 287-297, 300-301) whereas the region from 289-294 had the highest probability. The putative protein has high homology (>73%) to the putative protein sequences of PLEKHK1 described for mouse and rat. Several splice variants are characterized by Collier et al and additionally they show selective expression of this gene in resting $CD4^+$ T cells. This protein is located mainly in the cytoplasm. Expression analysis in different tissues demonstrated medium level expression in lung tissue while only low levels or absent expression of Cologne 2 was observed in all other tissues analyzed, including bone marrow, liver, heart, spleen, kidney, thymus, skeletal muscle, brain, spinal cord, prostate, and pancreas. It is suggested that Cologne 2 may be a maturity marker with an important role in developing lymphocytes ((Collier et al., Biochem. Biophys. Res. Commun.; 324: 1360-1369 (2004))) and regulation of this gene may be associated with cell proliferation and/or T cell activation signaling, lymphocyte division and differentiation.

Suitable MHC ligands/fragments of Cologne 2 can be identified by the method described in connection with Cologne 1 above.

Particular MHC fragments of Cologne 2 are shown in SEQ ID NOs:256-435.

HPGD:

Human HPGD (Hydroxyprostaglandin dehydrogenase 15-(NAD); hereinafter also referred to as "Cologne 3" or "Col3"), is located in the 175680186-175647955 genomic region on chromosome 4 in the 4q34-35 region. It consists of 7 exons resulting after transcription in an mRNA which has 2592 base pairs. The actual coding sequence itself consists of 801 base pairs (see SEQ ID NO:7). The translation of this sequence results in a putative protein with a length of 266 amino acids (SEQ ID NO:8).

Prostaglandins are involved in many physiologic and cellular processes, such as inflammation (Pichaud et al., Hum. Genet.; 99: 279-281 (1997)) and HPGD is the main enzyme of prostaglandin degradation. By catalyzing the conversion of the 15-hydroxyl group of prostaglandins into a keto group, this ubiquitous enzyme strongly reduces the biologic activity of these molecules.

The protein was screened for functional domains and Cologne 3 has a short chain dehydrogenase domain in the 8-250 region. This family contains a wide variety of dehydrogenases. Cologne 3 is a homodimer primarily located in the cytoplasm with the ability to catalyze the reaction of (5Z, 13E)-(15S)-11-alpha,15-dihydroxy-9-oxoprost-13-enoate+ $NAD^+$ to 5Z,13E)-11-alpha-hydroxy-9,15-dioxoprost-13-enoate+NADH and results in the inactivation of prostaglandins. Transmembrane domain prediction with an online transmembrane domain prediction server "DAS" identified 5 potential transmembrane regions (80, 162-170, 188-195, 238-240, 278-286) whereas the region from 164-167 had the highest probability. The putative protein has high homology (>88%) to the putative protein sequences of Cologne 3 described for mouse and rat. Expression analysis in different tissues demonstrated only low levels or absent expression of Cologne 3 in all tissues analyzed, including bone marrow, liver, heart, spleen, lung, kidney, thymus, skeletal muscle, brain, spinal cord, prostate, and pancreas.

Suitable MHC ligands/fragments of Cologne 3 can be identified by the method described in connection with Cologne 1 above.

Particular MHC fragments of Cologne 3 are shown in SEQ ID NOs:436-536.

DNAPTP6:

Human DNAPTP6 (DNA polymerase-transactivated protein 6; hereinafter also referred to as "Cologne 4" or "Col4"), is located in the 200879041-201051498 genomic region on chromosome 2 in the 2q33.1 region. It consists of 13 exons resulting after transcription in an mRNA which has 2355 base pairs (see SEQ ID NO:9). The actual coding sequence itself consists of 1677 base pairs. The translation of this sequence results in a putative protein with a length of 558 amino acids (SEQ ID NO:10).

The protein was screened for functional domains and Cologne 4 has a DUF1387 domain in the 59-368 region, which is stands for a domain of unknown function. This family represents a conserved region approximately 300 residues long within a number of hypothetical proteins of unknown function that seem to be restricted to mammals. Transmembrane domain prediction with an online transmembrane domain prediction server "DAS" identified 4 potential transmembrane regions (41-44, 72, 88, 409-416, 585-593) whereas the region from 587-591 had the highest probability. The putative protein has high homology (>89%) to the putative protein sequences of DNAPTP6 described for mouse, rat, and neat. Expression analysis in different tissues demonstrated only low levels or absent expression of Cologne 4 in all tissues analyzed, including bone marrow, liver, heart, spleen, lung, kidney, thymus, skeletal muscle, brain, spinal cord, prostate, and pancreas.

Suitable MHC ligands/fragments of Cologne 4 can be identified by the method described in connection with Cologne 1 above.

Particular MHC fragments of Cologne 4 are shown in SEQ ID NOs:537-660.

C1orf78:

Human C1orf78 (chromosome 1 open reading frame 78; hereinafter also referred to as "Cologne 5" or "Col5"), is located in the 36562342-36560219 genomic region on chromosome 1 in the 1p34.3 region. It consists of 3 exons resulting after transcription in an mRNA which has 1054 base pairs (see SEQ ID NO:11). The actual coding sequence itself consists of 495 base pairs. The translation of this sequence results in a putative protein with a length of 164 amino acids (SEQ ID NO:12).

The protein was screened for functional domains and no previously known domains could be identified for Cologne 5. Transmembrane domain prediction with an online transmembrane domain prediction server "DAS" identified 1 potential transmembrane region (68-93) wherein the region from 69-92 had the highest probability. The putative protein has high homology (>89%) to the putative protein sequences of Cologne 5 described for mouse and rat. Expression analysis in different tissues demonstrated medium level expression in lung, spleen, thymus, and brain tissues while only low levels or absent expression of Cologne 5 was observed in all other tissues analyzed, including bone marrow, liver, heart, kidney, skeletal muscle, spinal cord, prostate, and pancreas.

Suitable MHC ligands/fragments of Cologne 5 can be identified by the method described in connection with Cologne 1 above. Particular MHC fragments of Cologne 5 are shown in SEQ ID NOs:661-708.

FLJ45983:

Human FLJ45983 (FLJ45983 protein; from hereinafter also referred to as "Cologne 6" or "Col6"), is located in the 8135453-8132419 genomic region on chromosome 10 in the 10p14 region. It consists of 2 exons resulting after transcription in an mRNA which has 2213 base pairs (see SEQ ID NO:13). The actual coding sequence itself consists of 378 base pairs. The translation of this sequence results in a putative protein with a length of 125 amino acids (SEQ ID NO:14).

The protein was screened for functional domains and no previously known domains could be identified for Cologne 6. Transmembrane domain prediction with an online transmembrane domain prediction server "DAS" identified 1 potential transmembrane region (100-108). The putative protein product of Cologne 6 has no obvious homology to the known protein sequences described for mouse and rat. Expression analysis in different tissues demonstrated medium level expression in kidney tissue while only low levels or absent expression of Cologne 6 was observed in all other tissues analyzed, including bone marrow, liver, heart, spleen, lung, thymus, skeletal muscle, brain, spinal cord, prostate, and pancreas. Suitable MHC ligands/fragments of Cologne 6 can be identified by the method described in connection with Cologne 1 above.

Particular MHC fragments of Cologne 6 are shown in SEQ ID NOs:709-734.

ACTA2:

Human ACTA2 (actin, alpha 2, smooth muscle, aorta) is located in the 90702490-90684810 genomic region on chromosome 10 in the 10q23.3 region. It consists of 9 exons resulting after transcription in an mRNA which has 1330 base pairs (see SEQ ID NO:15). The actual coding sequence itself consists of 1134 base pairs. The translation of this sequence results in a putative protein with a length of 377 amino acids (SEQ ID NO:16).

Actin alpha 2, the human aortic smooth muscle actin gene, is one of six different actin isoforms which have been identified. Actins are highly conserved proteins that are involved in cell motility, structure and integrity. Alpha actins are a major constituent of the contractile apparatus.

The protein was screened for functional domains and ACTA2 has an actin domain in the 1-377 region, which belongs to the actin subfamily of actin/mreB/sugarkinase/Hsp70 superfamily. Any specificity is usually determined by loop regions or insertions in the N-terminus of the domain, which are not conserved across all PH domains. PH domains are found in cellular signaling proteins such as serine/threonine kinase, tyrosine kinases, regulators of G-proteins, endocytotic GTPases, adaptors, as well as cytoskeletal associated molecules and in lipid associated enzymese. Actin is a ubiquitous protein involved in the formation of filaments that are major components of the cytoskeleton. These filaments interact with myosin to produce a sliding effect, which is the basis of muscular contraction and many aspects of cell motility, including cytokinesis. Each actin protomer binds one molecule of ATP and has one high affinity site for either calcium or magnesium ions, as well as several low affinity sites. Actin exists as a monomer in low salt concentrations, but filaments form rapidly as salt concentration rises, with the consequent hydrolysis of ATP. Actin from many sources forms a tight complex with deoxyribonuclease (DNase I) although the significance of this is still unknown. The formation of this complex results in the inhibition of DNase I activity, and actin loses its ability to polymerise. It has been shown that an ATPase domain of actin shares similarity with ATPase domains of hexokinase and hsp70 proteins. In vertebrates there are three groups of actin isoforms: alpha, beta and gamma. The alpha actins are found in muscle tissues and are a major constituent of the contractile apparatus. The beta and gamma actins co-exists in most cell types as components of the cytoskeleton and as mediators of internal cell motility. In plants there are many isoforms which are probably involved in a variety of functions such as cytoplasmic streaming, cell shape determination, tip growth, graviperception, cell wall deposition, etc. Recently some divergent actin-like proteins have been identified in several species. These proteins include centractin (actin-RPV) from mammals, fungi yeast ACT5, *Neurospora crassa* ro-4) and *Pneumocystis carinii*, which seems to be a component of a multi-subunit centrosomal complex involved in microtubule based vesicle motility (this subfamily is known as ARP1); ARP2 subfamily, which includes chicken ACTL, *Saccharomyces cerevisiae* ACT2, *Drosophila melanogaster* 14D and *Caenorhabditis elegans* actC; ARP3 subfamily, which includes actin 2 from mammals, *Drosophila* 66B, yeast ACT4 and *Schizosaccharomyces pombe* act2; and ARP4 subfamily, which includes yeast ACT3 and *Drosophila* 13E. Transmembrane domain prediction with an online transmembrane domain prediction server "DAS" identified 2 potential transmembrane regions (133-145, 343-351) whereas the regions from 137-142 and 346-348 had the highest probability. The protein has high homology (>99%) to the protein sequences of ACTA2 described for mouse and rat. This protein is located mainly in the cytoplasm. Expression analysis in different tissues demonstrated medium level expression in heart tissue while only low levels or absent expression of ACTA2 was observed in all other tissues analyzed, including bone marrow, liver, lung, spleen, kidney, thymus, skeletal muscle, brain, spinal cord, prostate, and pancreas.

Suitable MHC ligands/fragments of human ACTA2 can be identified by the method described in connection with Cologne 1 above.

BFSP2:

Human BFSP2 (beaded filament structural protein 2, phakinin) is located in the 134601479-134676745 genomic region on chromosome 3 in the 3q21-q25 region. It consists of 7 exons resulting after transcription in an mRNA which has 1644 base pairs (see SEQ ID NO:17). The actual coding sequence itself consists of 1248 base pairs. The translation of this sequence results in a putative protein with a length of 415 amino acids (SEQ ID NO:18).

More than 99% of the vertebrate ocular lens is comprised of terminally differentiated lens fiber cells. Two lens-specific intermediate filament-like proteins, the protein product of this gene (BFSP2) and filensin (also known as CP115), are expressed only after fiber cell differentiation has begun. Both proteins are found in a structurally unique cytoskeletal element that is referred to as the beaded filament (BF). Mutations in this gene have been associated with juvenile-onset, progressive cataracts and Dowling-Meara epidermolysis bullosa simplex.

The protein was screened for functional domains and BFSP2 has 2 Coiled Coil domain in the 199-248 and 356-395 region. Coiled coil is a protein domain that forms a bundle of two or three alpha helices. Short coiled coil domains are involved in protein interactions but long coiled coil domains which from long rods occur in structural or motor proteins. Transmembrane domain prediction with an online transmembrane domain prediction server "DAS" identified 7 potential transmembrane regions (10-77, 80-203, 213-249, 254-320, 322-339, 344-1093, 1098-1240) whereas the regions from 34-65, 110-185, 355-1085, and 1124-1220 had the highest probability. The protein has high homology (>85%) to the protein sequences of BFSP2 described for mouse. This protein is located mainly in the cytoplasm and plasma membrane. Expression analysis in different tissues demonstrated high level expression in eye tissue while only low levels or absent expression of BFSP2 was observed in all other tissues analyzed, including bone marrow, liver, lung, heart, spleen, kidney, thymus, skeletal muscle, brain, spinal cord, prostate, and pancreas. The beaded filament is a cytoskeletal structure which is abundant in the fiber cells of the ocular lens. BFSP2 and CP115 are major components of the beaded filament. Alizadeh et al. (Alizadeh et al., Invest. Ophthalmol. Vis. Sci.; 45: 884-891 (2004)) characterized the genotype and phenotype of the 129 mouse strain (129/SvJ), which carries a mutation in the BFSP2 gene. The mutation consists of a 6,303-bp deletion from the end of intron B and the beginning of exon 2, resulting in loss of the exon 2 splice acceptor site, absence of exon 2 from the BFSP2 mRNA, and dramatically reduced levels of BFSP2 mRNA. Transcript levels of filensin (CP115), BFSP2's assembly partner, are normal, but protein levels are sharply reduced. Light microscopy established that the initial differentiation and elongation of fiber cells proceeded normally. Electron microscopy showed the absence of beaded filaments, whereas slit lamp microscopy showed a slowly emerging and progressive loss of optical clarity. Thus, Alizadeh et al. (Alizadeh et al., Invest. Ophthalmol. Vis. Sci.; 45: 884-891 (2004)) concluded that the 129 mouse strain behaves as a functional BFSP2 knockout.

Suitable MHC ligands/fragments of human BFSP2 can be identified by the method described in connection with Cologne 1 above.

CCL5:

Human CCL5 (chemokine (C-C motif) ligand 5), also known as RANTES, is located in the 31231489-31222607 genomic region on chromosome 17 in the 17q11.2-q12 region. It consists of 3 exons resulting after transcription in an mRNA which has 1237 base pairs (see SEQ ID NO:19). The actual coding sequence itself consists of 276 base pairs. The translation of this sequence results in a putative protein with a length of 91 amino acids (SEQ ID NO:20).

This gene is one of several CC cytokine genes clustered on the q-arm of chromosome 17. Cytokines are a family of secreted proteins involved in immunoregulatory and inflammatory processes. The CC cytokines are proteins characterized by two adjacent cysteines. The cytokine encoded by this gene functions as a chemoattractant for blood monocytes, memory T helper cells and eosinophils. It causes the release of histamine from basophils and activates eosinophils. This cytokine is one of the major HIV-suppressive factors produced by CD8+ cells. It functions as one of the natural ligands for the chemokine receptor CCR5 and it suppresses in vitro replication of the R5 strains of HIV-1, which use CCR5 as a coreceptor.

The protein was screened for functional domains and CCL5 has an intercrine alpha family (small cytokine C-X-C) (chemokine CXC) domain in the 30-88 region, which are often involved in cell-specific chemotaxis, mediation of cell growth, and the inflammatory response. Many low-molecular weight factors secreted by cells including fibroblasts, macrophages and endothelial cells, in response to a variety of stimuli such as growth factors, interferons, viral transformation and bacterial products, are structurally related. Most members of this family of proteins seem to have mitogenic, chemotactic or inflammatory activities. These small cytokines are also called intercrines or chemokines. They are cationic proteins of 70 to 100 amino acid residues that share four conserved cysteine residues involved in two disulphide bonds. These proteins can be sorted into two groups based on the spacing of the two amino-terminal cysteines. In the first group, the two cysteines are separated by a single residue (C-x-C), while in the second group, they are adjacent (C-C).

CLL5 additionally has an N-terminal signal peptide domain in the 1-23 region. It is usually located at the N terminus and normally absent from the mature protein. Normally refers to the sequence (ca. 20 amino acids) that interacts with signal recognition particle and directs the ribosome to the endoplasmic reticulum where co translational insertion takes place. Signal peptides are highly hydrophobic but with some positively charged residues. The signal sequence is normally removed from the growing peptide chain by signal peptidase, a specific protease located on the cisternal face of the endoplasmic reticulum. Transmembrane domain prediction with an online transmembrane domain prediction server "DAS" identified 1 potential transmembrane region (6-19) whereas the region from 6-18 had the highest probability. The protein has high homology (>80%) to the protein sequences of CCL5 described for mouse and rat. This protein is located mainly in the cytoplasm and nucleus. Expression analysis in different tissues demonstrated medium level expression in bone marrow, liver, spleen, thymus, and lung tissue while only low levels or absent expression of CCL5 was observed in all other tissues analyzed, including heart, kidney, skeletal muscle, brain, spinal cord, prostate, and pancreas. Cocchi et al. (Cocchi et al., Science; 270: 1811-1815 (1995)) demonstrated that RANTES is a major HIV-suppressive factors produced by CD8-positive T cells. Cocchi et al. (Cocchi et al., Science; 270: 1811-1815 (1995)) speculated that RANTES-mediated control of HIV may occur either directly, through its inherent anti-lentiretroviral activity, or indirectly, through its ability to chemoattract T cells and monocytes to the proximity of the infection foci. However, this latter mechanism may also have the opposite effect of providing new, uninfected targets for HIV infection. Using astrocytes obtained from 5-10 week-old fetal forebrains, Bakhiet et al. (Bakhiet et al., Nat. Cell. Biol.; 3: 150-157 (2001)) showed that expression of RANTES mRNA and protein increases with age. The RANTES receptors are CCR1, CCR3, and CCR5. Immunohistochemical and in situ hybridization analysis showed that cells expressing CCR5 do not express RANTES mRNA, while cells lacking CCR5 do express RANTES mRNA, suggesting a paracrine mode of action. Bakhiet et al. (Bakhiet et al., Nat. Cell. Biol.; 3: 150-157 (2001)) demonstrated that RANTES inhibited proliferation and prolonged survival of wildtype cells but had no effect on the Ccr5−/− cells. In response to RANTES stimulation, 5- and 10-week-old human astrocytes enhanced their production of gamma-interferon but only the older cells expressed IFNG receptor. RANTES stimulation of 5-week-old cells rapidly increased tyrosine kinase activity and protein phosphorylation. RANTES stimulation induced the translocation of STAT1 from the cytoplasm to the nucleus. Three putative PPAR response elements (PPREs) were found in the human RANTES promoter.

Once virus-infected cells are eliminated by cytotoxic lymphocytes, removal of these dead cells requires macrophage clearance without the macrophages being killed by virus. Tyner et al. (Tyner et al., Nat. Med.; 11: 1180-1187 (2005)) showed that CCl5-deficient mice had delayed viral clearance, excessive airway inflammation, and respiratory death after infection with either murine parainfluenza or human influenza viruses. CCL5 was required to hold apoptosis and mitochondrial dysfunction in check in virus-infected mouse macrophages in vivo and mouse and human macrophages ex vivo, and the protective effect of CCL5 required activation of CCR5 and the downstream ERK1/ERK2 and AKT signaling pathways.

RANTES is one of the natural ligands for the chemokine receptor CCR5 and potently suppresses in vitro replication of the R5 strains of HIV-1, which use CCR5 as a coreceptor.

Suitable MHC ligands/fragments of human CCL5 can be identified by the method described in connection with the Cologne 1 above.

CCR7:

Human CCR7 (chemokine (C-C motif) receptor 7) is located in the 35975249-35963546 genomic region on chromosome 17 in the 17q12-q21.2 region. It consists of 3 exons resulting after transcription in an mRNA which has 2188 base pairs (see SEQ ID NO:21). The actual coding sequence itself consists of 1137 base pairs. The translation of this sequence results in a putative protein with a length of 378 amino acids (SEQ ID NO:22).

The protein encoded by this gene is a member of the G protein-coupled receptor family. This receptor was identified as a gene induced by the Epstein-Barr virus (EBV), and is thought to be a mediator of EBV effects on B lymphocytes. This receptor is expressed in various lymphoid tissues and activates B and T lymphocytes. It has been shown to control the migration of memory T cells to inflamed tissues, as well as stimulate dendritic cell maturation. The chemokine (C-C motif) ligand 19 (CCL19/ECL) has been reported to be a specific ligand of this receptor. The protein was screened for functional domains and CCR7 has 7 transmembrane domains in the 63-85, 97-116, 131-150, 171-193, 229-251, 264-286, and 306-328 region. Transmembrane domains are composed of 15-30 hydrophobic residues and are found in proteins that span a membrane in a cell. A protein can have a single TM domain (e.g. Type I transmembrane receptors such as EGF receptor) or multiple TM domains (e.g. G-protein coupled receptors). To span the hydrocarbon core of the membrane of ~3 nm requires an alpha helix of ~20 uncharged predominantly apolar residues. Membrane separates two aqueous compartments by a thin two dimensional lipid phase. Membrane proteins generally span this lipid phase and therefore needed to accomodate to the hydrophilic stretch on both sides of the membrane as well as to the hydrophobic environment in the core of the bilayer. The structure of the membrane embedded portions consist of either of transmembrane alpha helices often assembled in to helix bundles or of antiparralel beta sheets forming barrel shaped pores. The length of the transmembrane helix may even correlate with the thickness of its membrane. Single spanning membrane proteins of the Endoplasmic reticulum (ER) and Golgi generally have shorter transmembrane domains than plasma membrane proteins. Since cholestrol content and thus the thickness of the lipid bilayer also increases along with the secretory pathway, this might reflect a role of the transmembrane segments and proteins in lipid sorting. In multi spanning membrane proteins the transmembrane helices are tightly bundled to compact, globular structure from which lipids are excluded. The protein has high homology (>86%) to the protein sequences of CCR7 described for mouse and rat. Expression analysis in different tissues demonstrated medium level expression in bone marrow, spleen, and thymus tissue as well as in lymphocytes while only low levels or absent expression of CCR7 was observed in all other tissues analyzed, including lung, liver, heart, kidney, skeletal muscle, brain, spinal cord, prostate, and pancreas. Naive and T helper-1 (TH1) cells express CCR7 and home to the periarteriolar lymphoid sheath in the spleen, whereas activated TH2 cells lack CCR7 and form rings at the periphery of the T-cell zones near B-cell follicles. Randolph et al. (Randolph et al., Science; 286: 2159-2162 (1999)) found that retroviral transduction of TH2 cells with CCR7 forced them to localize in a TH1-like pattern and inhibited their participation in B-cell help in vivo but not in vitro. Differential expression of chemokine receptors results in unique cellular migration patterns that are important for effective immune responses. Sallusto et al. (Sallusto et al., Nature; 401: 708-712 (1999)) demonstrated that expression of CCR7 divides human memory T cells into 2 functionally distinct subsets. CCR7− memory cells express receptors for migration to inflamed tissues and display immediate effector function. In contrast, CCR7+ memory cells express lymph node homing receptors and lack immediate effector function, but efficiently stimulate dendritic cells and differentiate into CCR7− effector cells upon secondary stimulation. The CCR7+ and CCR7−T cells, which Sallusto et al. (Sallusto et al., Nature; 401: 708-712 (1999)) named central memory (T-CM) and effector memory (T-EM), differentiate in a stepwise fashion from naive T cells, persist for years after immunization, and allow a division of labor in the memory response. Flow cytometric analyses of marker expression and cell division identified 4 subsets of CD8$^+$ T cells, representing a lineage differentiation pattern: CD45RA+CCR7$^+$ (double-positive); CD45RA−CCR7$^+$; CD45RA−CCR7$^-$ (double-negative); CD45RA+CCR7$^-$. The capacity for cell division, as measured by 5- (and 6-)carboxyl-fluorescein diacetate, succinimidyl ester, and intracellular staining for the Ki67 nuclear antigen, is largely confined to the CCR7$^+$ subsets and occurred more rapidly in cells that are also CD45RA$^+$. Although the double-negative cells did not divide or expand after stimulation, they did revert to positivity for either CD45RA or CCR7 or both. The CD45RA$^+$CCR7$^-$ cells, considered to be terminally differentiated, fail to divide, but do produce interferon-gamma and express high levels of perforin. B lymphocytes recirculate between B cell-rich compartments (follicles or B zones) in secondary lymphoid organs, surveying for antigen. After antigen binding, B cells move to the boundary of B and T zones to interact with T-helper cells. Reif et al. (Reif et al., Nature; 416: 94-99 (2002)) demonstrated that antigen-engaged B cells have increased expression of CCR7, the receptor for the T-zone chemokines CCL19 (also known as ELC) and CCL21, and that they exhibit increased responsiveness to both chemoattractants. In mice lacking lymphoid CCL19 and CCL21 chemokines, or with B cells that lack CCR7, antigen engagement fails to cause movement to the T zone. Using retroviral-mediated gene transfer, the authors demonstrated that increased expression of CCR7 is sufficient to direct B cells to the T zone. Reciprocally, overexpression of CXCR5, the receptor for the B-zone chemokine CXCL13, is sufficient to overcome antigen-induced B-cell movement to the T zone. Reif et al. (Reif et al., Nature; 416: 94-99 (2002)) concluded that their findings defined the mechanism of B-cell relocalization in response to antigen, and established that cell position in vivo can be determined by the balance of responsiveness to chemoattractants made in separate but adjacent zones.

Suitable MHC ligands/fragments of human CCR7 can be identified by the method described in connection with the Cologne 1 above.

CD40LG:

Human CD40LG (CD40 ligand; TNF superfamily, member 5, hyper-IgM syndrome), also known as CD154, is located in the 135558001-135570214 genomic region on chromosome 10 in the Xq26 region. It consists of 5 exons resulting after transcription in an mRNA which has 1834 base pairs (see SEQ ID NO:23). The actual coding sequence itself consists of 786 base pairs. The translation of this sequence results in a putative protein with a length of 261 amino acids (SEQ ID NO:24).

The protein encoded by this gene is expressed on the surface of T cells. It regulates B cell function by engaging CD40 on the B cell surface. A defect in this gene results in an inability to undergo immunoglobulin class switch and is associated with hyper-IgM syndrome.

The protein was screened for functional domains and CD40LG has a transmembrane domain in the 23-45 region. Transmembrane domains are composed of 15-30 hydrophobic residues and are found in proteins that span a membrane in a cell. A protein can have a single TM domain (e.g. Type I transmembrane receptors such as EGF receptor) or multiple TM domains (e.g. G-protein coupled receptors). To span the hydrocarbon core of the membrane of ~3 nm requires an alpha helix of ~20 uncharged predominantly apolar residues. Membrane separates two aqueous compartments by a thin two dimensional lipid phase. Membrane proteins generally span this lipid phase and therefore needed to accomodate to the hydrophilic stretch on both sides of the membrane as well as to the hydrophobic environment in the core of the bilayer. The structure of the membrane embedded portions consist of either of transmembrane alpha helices often assembled in to helix bundles or of antiparralel beta sheets forming barrel shaped pores. The length of the transmembrane helix may even correlate with the thickness of its membrane. Single spanning membrane proteins of the Endoplasmic reticulum (ER) and Golgi generally have shorter transmembrane domains than plasma membrane proteins. Since cholestrol content and thus the thickness of the lipid bilayer also increases along with the secretory pathway, this might reflect a role of the transmembrane segments and proteins in lipid sorting. In multi spanning membrane proteins the transmembrane helices are tightly bundled to compact, globular structure from which lipids are excluded. CD40LG additionally has a tumour necrosis factor family domain in the 122-261 region, which belongs to a family of cytokines that form homotrimeric or heterotrimeric complexes. CD40L is a cytokine which seems to be important in B-cell development and activation. All these cytokines seem to form homotrimeric (or heterotrimeric in the case of LT-alpha/beta) complexes that are recognized by their specific receptors. The PROSITE pattern for this family is located in a beta-strand in the central section of the protein which is conserved across all members. The protein has high homology (>77%) to the protein sequences of CD40LG described for mouse and rat. This protein is located mainly in the plasma membrane. Expression analysis in different tissues demonstrated high level expression in T cells and platelets while only low levels or absent expression of CD40L was observed in all other tissues analyzed. The CD40 ligand molecule aids in stimulating B cells in the immune response. The CD40 molecule is a glycoprotein expressed on B lymphocytes, epithelial cells, and some carcinoma cells. Crosslinking of CD40 by anti-CD40 monoclonal antibodies mediates B cell proliferation, adhesion, and differentiation. Gauchat et al. (Gauchat et al., FEBS Lett.; 315: 259-266 (1993)) demonstrated that the human CD40 ligand can be detected on T cells but is absent from B cells and monocytes. It is expressed on both CD4- and CD8-positive T cells. CD40 ligand is also expressed on platelets and released from them on activation. Multiple mutations in CD40LG gene have been identified that are associated with hyper-IgM immunodeficiency syndrome type 1.

Suitable MHC ligands/fragments of human CD40LG can be identified by the method described in connection with the Cologne 1 above.

CTLA4:

Human CTLA4 (cytotoxic T-lymphocyte-associated protein 4), also known as CD152, is located in the 204440753-204446927 genomic region on chromosome in the 2q33 region. Isoform a consists of 4 exons resulting after transcription in an mRNA which has 1988 base pairs (see SEQ ID NO:25). The actual coding sequence itself consists of 672 base pairs. The translation of this sequence results in a putative protein with a length of 223 amino acids (SEQ ID NO:26). Isoform b consists of 3 exons resulting after transcription in an mRNA which has 1878 base pairs (see SEQ ID NO:27). The actual coding sequence itself consists of 525 base pairs. The translation of this sequence results in a putative protein with a length of 174 amino acids (SEQ ID NO:28).

This gene is a member of the immunoglobulin superfamily and encodes a protein which transmits an inhibitory signal to T cells. The protein contains a V domain, a transmembrane domain, and a cytoplasmic tail. Alternate transcriptional splice variants, encoding different isoforms, have been characterized. The membrane-bound isoform functions as a homodimer interconnected by a disulfide bond, while the soluble isoform functions as a monomer. Mutations in this gene have been associated with insulin-dependent diabetes mellitus, Graves disease, Hashimoto thyroiditis, celiac disease, systemic lupus erythematosus, thyroid-associated orbitopathy, and other autoimmune diseases.

The protein was screened for functional domains and CTLA4 has an immunoglobulin-like domain in the 53-131 region. Ig molecules are highly modular proteins, in which the variable and constant domains have clear, conserved sequence patterns. The domains in Ig and Ig-like molecules are grouped into four types: V-set (variable), C1-set (constant-1), C2-set (constant-2) and I-set (intermediate). Structural studies have shown that these domains share a common core Greek-key beta-sandwich structure, with the types differing in the number of strands in the beta-sheets as well as in their sequence patterns. Immunoglobulin-like domains that are related in both sequence and structure can be found in several diverse protein families. Ig-like domains are involved in a variety of functions, including cell-cell recognition, cell-surface receptors, muscle structure and the immune system. In addition, CTLA4 has a transmembrane domain in the 162-184 region. Transmembrane domains are composed of 15-30 hydrophobic residues and are found in proteins that span a membrane in a cell. A protein can have a single TM domain (e.g. Type I transmembrane receptors such as EGF receptor) or multiple TM domains (e.g. G-protein coupled receptors). To span the hydrocarbon core of the membrane of ~3 nm requires an alpha helix of ~20 uncharged predominantly apolar residues. Membrane separates two aqueous compartments by a thin two dimensional lipid phase. Membrane proteins generally span this lipid phase and therefore needed to accomodate to the hydrophilic stretch on both sides of the membrane as well as to the hydrophobic environment in the core of the bilayer. The structure of the membrane embedded portions consist of either of transmembrane alpha helices often assembled in to helix bundles or of antiparrafel beta sheets forming barrel shaped pores. The length of the transmembrane helix may even correlate with the thickness of its membrane. Single spanning membrane proteins of the Endoplasmic reticulum (ER) and Golgi generally have shorter transmembrane domains than plasma membrane proteins. Since cholestrol content and thus the thickness of the lipid bilayer also increases along with the secretory pathway, this might reflect a role of the transmembrane segments and proteins in lipid sorting. In multi spanning membrane proteins the transmembrane helices are tightly bundled to compact, globular structure from which lipids are excluded. CTLA4 additionally has an N-terminal signal peptide domain in the 1-36 region. It is usually located at the N terminus and normally absent from the mature protein. Normally refers to the sequence (ca. 20 amino acids) that interacts with signal recognition particle and directs the ribosome to the endoplasmic reticulum where co translational insertion takes place. Signal peptides are highly hydrophobic but with some positively charged residues. The signal sequence is normally removed from the growing peptide chain by signal peptidase, a specific protease located on the cisternal face of the endoplasmic reticulum. The protein has high homology (>74%) to the protein sequences of CTLA4 described for mouse and rat. This protein is located mainly in the plasma membrane. Expression analysis in different tissues demonstrated medium level expression in activated T cells, the spleen, bone marrow, thymus, and lung tissue while only low levels or absent expression of CTLA4 was observed in all other tissues analyzed, including liver, heart, kidney, skeletal muscle, brain, spinal cord, prostate, and pancreas. CTLA4 is a member of the immunoglobulin superfamily and is a costimulatory molecule expressed by activated T cells. CTLA4 is similar to the T-cell costimulatory CD28, and both molecules bind to B7-1 (CD80) and B7-2 (CD86) on antigen-presenting cells. CTLA4 transmits an inhibitory signal to T cells, whereas CD28 transmits a stimulatory signal. CTLA4 contains a leader sequence, a V domain, a transmembrane domain, and a cytoplasmic tail encoded by 4 exons, respectively. The cytoplasmic tail contains 2 potential phosphorylation sites. Northern blot analysis detected 2 CTLA4 mRNA transcripts of 1.8 and 0.8 kb in activated peripheral blood T cells. Linsley et al. (Linsley et al., J. Biol. Chem.; 270: 15417-15424 (1995)) demonstrated that the CTLA4 protein is a homodimer interconnected by a disulfide bond in the extracellular domain at cysteine residue 120. Each monomeric polypeptide contains a high affinity binding site for the costimulatory molecules B7-1 and B7-2. Using RT-PCR, Magistrelli et al. (Magistrelli et al., Eur. J. Immunol.; 29: 3596-3602 (1999)) found that nonactivated human peripheral blood T lymphocytes expressed an alternatively spliced form of CTLA4. The splicing induces deletion of the transmembrane region encoded by exon 2, resulting in the production of a soluble form of the protein with a molecular mass of 23 kD; membrane CTLA4 has an apparent molecular mass of 45 kD, suggesting that the soluble form is a monomeric protein. Functional studies showed that the soluble form of CTLA4 is downregulated by T-cell activation, in contrast to membrane CTLA4, which is upregulated by T-cell activation. CTLA4 binds to the B7 isoforms with an affinity that is 10 to 100 times that of CD28. Ostrov et al. (Ostrov et al., Science; 290: 816-819 (2000)) determined the crystal structure of the extracellular portion of murine Ctla4 at 2.0-angstrom resolution. Consistent with its membership in the Ig superfamily, Ctla4 displays a strand topology similar to V-alpha domains. Ctla4 has an unusual dimerization mode that places the B7 binding sites distal to the dimerization interface, allowing each Ctla4 dimer to bind 2 divalent B7 molecules. The authors suggested that periodic rearrangement of these components might explain the role of CTLA4 in the regulation of T-cell responsiveness. Oaks et al. (Oaks et al., Cell. Immunol.; 201: 144-153 (2000)) found that activation of human lymphocytes resulted in the disappearance of sCTLA4 at 48 hours followed by its gradual reappearance, whereas CTLA4-TM rapidly increased and remained present at the same level after activation. CTLA4Ig is a soluble chimeric protein consisting of the extracellular domain of human CTLA4 and a fragment of the Fc portion of human IgG1. It binds to B7-1 and to B7-2 molecules on antigen-presenting cells (APCs) and thereby blocks the CD28-mediated costimulatory signal for T-cell activation. Fallarino et al. (Fallarino et al., Nat. Immunol.; 4: 1206-1212 (2003)) showed that mouse CD4+/CD25+ Tr cells expressing Ctla4 conditioned B7-expressing DCs to express Ido and produce Ifng. DCs conditioned in vitro by Tr cells mediated suppressive effects in vivo that were dependent on effective tryptophan catabolism. The requirement for Ctla4 expression was overcome in Tr cells stimulated with lipopolysaccharide to produce substantial amounts of Ifng and interleukin-10 (IL10). Fallarino et al. (Fallarino et al., Nat. Immunol.; 4: 1206-1212 (2003)) concluded that Tr cells prime DCs for tolerance induction through IDO-based immunoregulation. Using in vitro migration assays and in vivo 2-photon laser scanning microscopy, Schneider et al. (Schneider et al., Science; 313: 1972-1975 (2006)) showed that CTLA4 increases T-cell motility and overrides the T-cell receptor (TCR)-induced stop signal required for stable conjugate formation between T cells and antigen-presenting cells. This event led to reduced contact periods between T cells and antigen-presenting cells that in turn decreased cytokine production and proliferation. Schneider et al. (Schneider et al., Science; 313: 1972-1975 (2006)) concluded that their results suggested a fundamentally different model of reverse stop signaling, by which CTLA4 modulates the threshold for T-cell activation and protects against autoimmunity.

Suitable MHC ligands/fragments of human CTLA4 can be identified by the method described in connection with the Cologne 1 above.

CTSL1:

Human CTSL1 (cathepsin L1) is located in the 89530799-89536127 genomic region on chromosome 9 in the 9q21-q22 region. Isoform a consists of 6 exons resulting after transcription in an mRNA which has 1731 base pairs. Isoform b consists of 6 exons resulting after transcription in an mRNA which has 1587 base pairs (see SEQ ID NO:29). Both isoform encode for the same protein of which the actual coding sequence itself consists of 1002 base pairs. The translation of this sequence results in a putative protein with a length of 333 amino acids (SEQ ID NO:30).

The protein encoded by this gene is a lysosomal cysteine proteinase that plays a major role in intracellular protein catabolism. Its substrates include collagen and elastin, as well as alpha-1 protease inhibitor, a major controlling element of neutrophil elastase activity. The encoded protein has been implicated in several pathologic processes, including myofibril necrosis in myopathies and in myocardial ischemia, and in the renal tubular response to proteinuria. This protein, which is a member of the peptidase C1 family, is a dimer composed of disulfide-linked heavy and light chains, both produced from a single protein precursor. At least two transcript variants encoding the same protein have been found for this gene. The protein was screened for functional domains and CTSL1 has a papain family cysteine protease domain in the 114-332 region. The papain family has a wide variety of activities, including broad-range (papain) and narrow-range endo-peptidases, aminopeptidases, dipeptidyl peptidases and enzymes with both exo- and endo-peptidase activity. Members of the papain family are widespread, found in baculovirus eubacteria, yeast, and practically all protozoa, plants and mammals. The proteins are typically lysosomal or secreted, and proteolytic cleavage of the propeptide is required for enzyme activation, although bleomycin hydrolase is cytosolic in fungi and mammals. Papain-like cysteine proteinases are essentially synthesised as inactive proenzymes (zymogens) with N-terminal propeptide regions. The activation process of these enzymes includes the removal of propeptide regions. The propeptide regions serve a variety of functions in vivo and in vitro. The pro-region is required for the proper folding of the newly synthesised enzyme, the inactivation of the peptidase domain and stabilisation of the enzyme against denaturing at neutral to alkaline pH conditions. Amino acid residues within the pro-region mediate their membrane association, and play a role in the transport of the proenzyme to lysosomes. Among the most notable features of propeptides is their ability to inhibit the activity of their cognate enzymes and that certain propeptides exhibit high selectivity for inhibition of the peptidases from which they originate. The catalytic residues of papain are Cys-25 and His-159, other important residues being Gln-19, which helps form the 'oxyanion hole', and Asn-175, which orientates the imidazole ring of His-159 Transmembrane domain prediction with an online transmembrane domain prediction server "DAS" identified 2 potential transmembrane regions (6-19, 239-249, 278-283) whereas the regions from 7-17 and 242-243 had the highest probability. The protein sequence of CTSL1 has no homology to genes described for mouse and rat. Cathepsin L is a lysosomal cysteine proteinase with a major role in intracellular protein catabolism. It also shows the most potent collagenolytic and elastinolytic activity in vitro of any of the cathepsins. Cathepsin L proteolytically inactivates alpha-1 protease inhibitor, a major controlling element of human neutrophil elastase activity in vivo. Cathepsin L has been implicated in pathologic processes including myofibril necrosis in myopathies and in myocardial ischemia, and in the renal tubular response to proteinuria (Joseph et al., J. Clin. Invest.; 81: 1621-1629 (1988)). Urbich et al. (Urbich et al., Nat. Med.; 11: 206-213 (2005)) found that cathepsin L is highly expressed in progenitor cells compared to mature endothelial cells and is essential for matrix degradation and invasion in vitro. Ctsl-null mice showed impaired functional recovery following hind limb ischemia, and infused Ctsl-deficient progenitor cells neither homed to sites of ischemia nor augmented neovascularization. Forced expression of cathepsin L in mature endothelial cells enhanced invasive activity and neovascularization in vivo. Urbich et al. (Urbich et al., Nat. Med.; 11: 206-213 (2005)) concluded that cathepsin L has a critical role in the integration of circulating endothelial progenitor cells into ischemic tissue and is required for endothelial progenitor cell-mediated neovascularization. Lysosomal proteases generate peptides presented by class II MHC molecules to CD4+ T cells. To determine whether specific lysosomal proteases influence the outcome of a CD4+ T cell-dependent autoimmune response, Maehr et al. (Maehr et al., J. Clin. Invest.; 115: 2934-2943 (2005)) generated mice that lack Ctsl on the autoimmune diabetes-prone NOD inbred background. The absence of Ctsl afforded strong protection from disease at the stage of pancreatic infiltration. Within the CD4+ T cell compartments of the Ctsl-deficient mice, there was an increased proportion of regulatory T cells compared with that in Ctsl-sufficient littermates. Maehr et al. (Maehr et al., J. Clin. Invest.; 115: 2934-2943 (2005)) suggested that it is this displaced balance of regulatory versus aggressive CD4+ T cells that protects Ctsl-deficient mice from autoimmune disease. The results identified Ctsl as an enzyme whose activity is essential for the development of type I diabetes in the NOD mouse.

Suitable MHC ligands/fragments of human CTSL1 can be identified by the method described in connection with the Cologne 1 above.

EOMES:

Human EOMES (eomesodermin homolog (*Xenopus laevis*)) is located in the 27738788-27732871 genomic region on chromosome 3 in the 3p21.3-p21.2 region. It consists of 6 exons resulting after transcription in an mRNA which has 2756 base pairs (see SEQ ID NO:33). The actual coding sequence itself consists of 2061 base pairs. The translation of this sequence results in a putative protein with a length of 686 amino acids (SEQ ID NO:34).

This gene encodes a member of a conserved protein family that shares a common DNA-binding domain, the T-box. T-box genes encode transcription factors involved in the regulation of developmental processes. A similiar gene disrupted in mice is shown to be essential during trophoblast development and gastrulation. The protein was screened for functional domains and EOMES has a TBOX domain first found in the mice T locus (Brachyury) in the 266-461 region. Transcription factors of the T-box family are required both for early cell-fate decisions, such as those necessary for formation of the basic vertebrate body plan, and for differentiation and organogenesis. The T-box is defined as the minimal region within the T-box protein that is both necessary and sufficient for sequence-specific DNA binding, all members of the family so far examined bind to the DNA consensus sequence TCACACCT. The T-box is a relatively large DNA-binding domain, generally comprising about a third of the entire protein (17-26 kDa). These genes were uncovered on the basis of similarity to the DNA binding domain of murine Brachyury (T) gene product, which similarity is the defining feature of the family. The Brachyury gene is named for its phenotype, which was identified 70 years ago as a mutant mouse strain with a short blunted tail. The gene, and its paralogues, have become a well-studied model for the family, and hence much of what is known about the T-box family is derived from the murine Brachyury gene. Consistent with its nuclear location, Brachyury protein has a sequence-specific DNA-binding activity and can act as a transcriptional regulator. Homozygous mutants for the gene undergo extensive developmental anomalies, thus rendering the mutation lethal. The postulated role of Brachyury is as a transcription factor, regulating the specification and differentiation of posterior mesoderm during gastrulation in a dose-dependent manner. T-box proteins tend to be expressed in specific organs or cell types, especially during development, and they are generally required for the development of those tissues, for example, Brachyury is expressed in posterior mesoderm and in the developing notochord, and it is required for the formation of these cells in mice. Transmembrane domain prediction with an online transmembrane domain prediction server "DAS" identified 4 potential transmembrane regions (10-14, 118-130, 250-261, 316-317) whereas the region from 121-127 had the highest probability. The protein has high homology (>86%) to the protein sequences of EOMES described for mouse and rat. Expression analysis in different tissues demonstrated medium level expression in spleen tissue while only low levels or absent expression of EOMES was observed in all other tissues analyzed, including bone marrow, liver, lung, heart, spleen, kidney, thymus, skeletal muscle, brain, spinal cord, prostate, and pancreas. Mutations in the mouse T (Brachyury) gene cause defects in mesoderm formation. Several related genes, members of the T-box gene family, encode a similar N-terminal DNA-binding domain, the T-box, and play critical roles in human embryonic development. Mutations in human TBX5 and TBX3, for example, cause the developmental disorders Holt-Oram syndrome and ulnar-mammary syndrome, respectively. Pearce et al. (Pearce et al., Science; 302: 1041-1043 (2003)) showed that eomesodermin, a paralog of Tbet, is induced in effector CD8(+) T cells in vitro and in vivo. Ectopic expression of Eomes was sufficient to invoke attributes of effector CD8(+) T cells, including interferon-gamma, perforin, and granzyme B. Loss-of-function analysis suggested that Eomes may also be necessary for full effector differentiation of CD8(+) T cells. Pearce et al. (Pearce et al., Science; 302: 1041-1043 (2003)) suggested that eomesodermin is likely to complement the actions of Tbet and act as a key regulatory gene in the development of cell-mediated immunity.

Suitable MHC ligands/fragments of human EOMES can be identified by the method described in connection with the Cologne 1 above.

EPB41L3:

Human EPB41L3 (erythrocyte membrane protein band 4.1-like 3) is located in the 5533985-5382387 genomic region on chromosome 18 in the 18p11.32 region. It consists of 16 exons resulting after transcription in an mRNA which has 4446 base pairs (see SEQ ID NO:35). The actual coding sequence itself consists of 3264 base pairs. The translation of this sequence results in a putative protein with a length of 1087 amino acids (SEQ ID NO:36).

The protein was screened for functional domains and EPB41L3 has a Band 4.1 homologues domain in the 106-301 region, which is also known as ezrin/radixin/moesin (ERM) protein domain present in myosins, ezrin, radixin, moesin, protein tyrosine phosphatases. These proteins play structural and regulatory roles in the assembly and stabilization of specialized plasmamembrane domains. Some PDZ domain containing proteins bind one or more of this family. Now includes JAKs. This domain is found in a number of cytoskeletal-associated proteins that associate with various proteins at the interface between the plasma membrane and the cytoskeleton. It is a conserved N-terminal domain of about 150 residues involved in the linkage of cytoplasmic proteins to the membrane. EPB41L3 additionally has a Coiled Coil domain in the 708-742 region. Coiled coil is a protein domain that forms a bundle of two or three alpha helices. Short coiled coil domains are involved in protein interactions but long coiled coil domains which from long rods occur in structural or motor proteins. Transmembrane domain prediction with an online transmembrane domain prediction server "DAS" identified 4 potential transmembrane regions (218-231, 311-322, 586-590, 630-667) whereas the regions from 220-230, 313-320, and 632-664 had the highest probability. The protein has high homology (>88%) to the protein sequences of EPB41L3 described for mouse and rat. This protein is located mainly in the plasma membrane. Expression analysis in different tissues demonstrated medium level expression in brain, kidney, testis, and intestine tissue while only low levels or absent expression of EPB41L3 was observed in all other tissues analyzed, including bone marrow, lung, liver, heart, spleen, thymus, skeletal muscle, spinal cord, prostate, and pancreas.

Suitable MHC ligands/fragments of human EPB41L3 can be identified by the method described in connection with the Cologne 1 above.

FCGBP:

Human FCGBP (Fc fragment of IgG binding protein) is located in the 45132372-45045810 genomic region on chromosome 19 in the 19q13.1 region. FCGBP consists of 31 exons resulting after transcription in an mRNA which has 9378 base pairs (see SEQ ID NO:39). The actual coding sequence itself consists of 9213 base pairs. The translation of this sequence results in a protein with a length of 3070 amino acids (SEQ ID NO:40).

In some non-lymphoid tissues, the unrearranged T cell receptor gamma (TRGγ) locus is expressed. The resulting transcript contains a subset of the TRGγ gene segments and is shorter than TRGγ transcripts expressed in lymphoid tissues. This RefSeq record represents the unrearranged TRGγ locus transcript; the complete TRGγ locus is represented by the genomic RefSeq NG_001336. The transcript represented by this RefSeq has two open reading frames (ORFs) that encode different proteins. The downstream ORF is in the same frame as TRGγ and its protein product is similar to TRGγ proteins. The upstream ORF uses a different reading frame and encodes a novel protein.

The protein was screened for functional domains and FCGBP has 13 von Willebrand factor (vWF) type D domains in the 463-627, 862-1019, 1249-1406, 1662-1831, 2064-2222, 2450-2607, 2863-3032, 3265-3423, 3651-3808, 4064-4233, 4463-4624, 4848-5002, and 5228-5382 region. Von Willebrand factor contains several type D domains: D1 and D2 are present within the N-terminal propeptide whereas the remaining D domains are required for multimerisation. A family of growth regulators (originally called cef10, connective tissue growth factor, fisp-12, cyr61, or, alternatively, beta IG-M1 and beta IG-M2), all belong to immediate-early genes expressed after induction by growth factors or certain oncogenes. Sequence analysis of this family revealed the presence of four distinct modules. Each module has homologues in other extracellular mosaic proteins such as Von Willebrand factor, slit, thrombospondins, fibrillar collagens, IGF-binding proteins and mucins. Classification and analysis of these modules suggests the location of binding regions and, by analogy to better characterized modules in other proteins, sheds some light onto the structure of this new family. The vWF domain is found in various plasma proteins: complement factors B, C2, CR3 and CR4; the integrins (I-domains); collagen types VI, VII, XII and XIV; and other extracellular proteins. Although the majority of VWA-containing proteins are extracellular, the most ancient ones present in all eukaryotes are all intracellular proteins involved in functions such as transcription, DNA repair, ribosomal and membrane transport and the proteasome. A common feature appears to be involvement in multiprotein complexes. Proteins that incorporate vWF domains participate in numerous biological events (e.g. cell adhesion, migration, homing, pattern formation, and signal transduction), involving interaction with a large array of ligands. A number of human diseases arise from mutations in VWA domains. Secondary structure prediction from 75 aligned vWF sequences has revealed a largely alternating sequence of alpha-helices and beta-strands. One of the functions of von Willebrand factor (vWF) is to serve as a carrier of clotting factor VIII (FVIII). The native conformation of the D' domain of vWF is not only required for factor VIII (FVIII) binding but also for normal multimerization and optimal secretion. Transmembrane domain prediction with an online transmembrane domain prediction server "DAS" identified for FCGBP 8 potential transmembrane regions (11-15, 312-318, 580-586, 416-419, 1801-1807, 1827-1830, 2578-2581, 2901-2904). No homology to known mouse or rat protein sequences has been reported for the human protein sequence of FCGBP. This protein is located mainly extracellularly. Expression analysis in different tissues demonstrated medium level expression in intestine, spleen, kidney, lung, thymus, prostate, and pancreas tissue while only low levels or absent expression of FCGBP was observed in all other tissues analyzed, including bone marrow, liver, heart, brain skeletal muscle, and spinal cord.

Suitable MHC ligands/fragments of human FCGBP can be identified by the method described in connection with the Cologne 1 above.

FHIT:

Human FHIT (fragile histidine triad gene), also known as FRA3B or AP3Aase, is located in the 59,712,992-60,497,735 genomic region on Chromosome 3 in the 3p14.2 region. It consists of 5 exons resulting after transcription in an mRNA which has 1095 base pairs (see SEQ ID NO:41). The actual coding sequence itself consists of 444 base pairs. The translation of this sequence results in a protein with a length of 147 amino acids (SEQ ID NO:42).

This gene, a member of the histidine triad gene family, encodes a diadenosine 5',5'''-P1,P3-triphosphate hydrolase involved in purine metabolism. The gene encompasses the common fragile site FRA3B on chromosome 3, where carcinogen-induced damage can lead to translocations and aberrant transcripts of this gene. In fact, aberrant transcripts from this gene have been found in about half of all esophageal, stomach, and colon carcinomas.

The protein was screened for functional domains, FHIT has a histidine triad (HIT) motif encompassing the whole protein. The Histidine Triad (HIT) motif, His-phi-His-phi-His-phi-phi (phi, a hydrophobic amino acid) was identified as being highly conserved in a variety of organisms. Crystal structure of rabbit Hint, purified as an adenosine and AMP-binding protein, showed that proteins in the HIT superfamily are conserved as nucleotide-binding proteins and that Hint homologs, which are found in all forms of life, are structurally related to Fhit homologs and GalT-related enzymes, which have more restricted phylogenetic profiles. Hint homologs including rabbit Hint and yeast Hnt1 hydrolyze adenosine 5' mono-phosphoramide substrates such as AMP-NH2 and AMP-lysine to AMP plus the amine product and function as positive regulators of Cdk7/Kin28 in vivo. Fhit homologs are diadenosine polyphosphate hydrolases and function as tumor suppressors in human and mouse though the tumor suppressing function of Fhit does not depend on ApppA hydrolysis. The third branch of the HIT superfamily, which includes GalT homologs, contains a related His-X-His-X-Gln motif and transfers nucleoside monophosphate moeities to phosphorylated second substrates rather than hydrolyzing them.

Transmembrane domain prediction with an online transmembrane domain prediction server "DAS" identified no transmembrane regions. FHIT has high homology (>88%) to the FHIT protein sequences for mouse and rat. Huebner and Croce ((Huebner and Croce, Br. J. Cancer; 88: 1501-1506 (2003))) reviewed the mutations in FHIT in primary tumors and the associated clinical features. They pointed out that since the FHIT gene was discovered in 1996 more than 350 reports of studies had been published. The data they summarized indicated that FHIT is altered in many human tumors, particularly in those caused by environmental carcinogens, such as those present in tobacco smoke. In many of these tumors, particularly in those induced by tobacco or other environmental carcinogens, alterations of FHIT occur very early during the multistep process of carcinogenesis. Huebner and Croce (Huebner and Croce, Nat. Rev. Cancer; 1: 214-221 (2001)) showed that FHIT-negative cancer cells are very sensitive to the expression of FHIT; for example, infection with FHIT recombinant viruses can cause regression and prevention of tumors in experimental animals. Thus, it is logical to predict the development of a gene therapy approach for the treatment and prevention of FHIT-negative human cancers.

Suitable MHC ligands/fragments of human FHIT can be identified by the method described in connection with the Cologne 1 above.

FLOT1:

Human FLOT1 (flotillin 1), also known as integral membrane component of caveolae, is located in the 30803465-30818443 genomic region on chromosome 6 in the 6p21.3 region. It consists of 10 exons resulting after transcription in an mRNA which has 1462 base pairs (see SEQ ID NO:43). The actual coding sequence itself consists of 1284 base pairs. The translation of this sequence results in a protein with a length of 305 amino acids (SEQ ID NO:44).

Caveolae are small domains on the inner cell membrane involved in vesicular trafficking and signal transduction. FLOT1 encodes a caveolae-associated, integral membrane protein.

FLOT1 was screened for functional domains and has a Band 7 domain in the 1-185 region and a flotilin domain in the 190-363 region. Flotillins are integral membrane proteins that have been shown to be present in several subcellular components, including caveolae (invaginated plasma membrane microdomains), lipid rafts (sphingolipid and cholesterol-rich, detergent-resistant plasma membrane microdomains), and the Golgi apparatus. The molecular function of flotillins remains uncertain. They are probably involved in organising the structure of caveolae and lipid rafts, and other detergent resistant membrane domains. They may also be involved in signal transduction. Flotillins have been shown to accumulate in brain cells with the development of Alzheimer's pathology. Also included in this family are Reggie proteins, which are expressed in non-caveolar neuronal plasma membrane domains. Transmembrane domain prediction with an online transmembrane domain prediction server "DAS" identified no potential transmembrane regions. FLOT1 has very high homology (>98%) to the FLOT1 protein sequences described for mouse and rat. Zhang et al. (Zhang et al., Genome Res.; 10: 1546-1560 (2000)) purified human FLOT1 by RT-PCR from CD34+ cord blood and adult bone marrow. By analyzing microarrays, they found weak expression of FLOT1 in 4 of 5 hematopoietic cell lines and no expression in a promyelocytic cell line. Northern blot analysis of mouse tissues revealed expression in adipose tissue, heart, skeletal muscle, and lung. By Western blot analysis, Flot1 was also found as a 47-kD protein in caveolin-rich membrane domains isolated from human lung and from cultured mouse adipocytes.

Suitable MHC ligands/fragments of human FLOT1 can be identified by the method described in connection with the Cologne 1 above.

FOXP3:

Human FOXP3 (forkhead box P3), also known as IPEX or scurfin, is located in the 48993841-49008232 genomic region on chromosome X in the Xp11.23 region. The full length transcript consists of 12 exons resulting after transcription in an mRNA which has 6659 base pairs. The actual coding sequence itself consists of 1830 base pairs. The translation of this sequence results in a putative protein with a length of 609 amino acids.

Chatila et al. (Chatila et al., J. Clin. Invest.; 106: R75-81 (2000)) stated that the human FOXP3 open reading frame of 1,146 bp encodes a deduced 381-amino acid protein. By PCR of a human peripheral blood mononuclear cell cDNA library, Smith et al. (Smith et al., Immunology; 119: 203-211 (2006)) cloned full-length FOXP3 and splice variants lacking exon 2 and both exons 2 and 7. The full-length protein contains 431 amino acids. The variant lacking exon 2 encodes a 396-amino acid protein lacking part of the proline-rich domain, and the variant lacking exons 2 and 7 encodes a 369-amino acid protein that also lacks a large part of the putative leucine zipper. Smith et al. (Smith et al., Immunology; 119: 203-211 (2006)) noted that mice appear to lack Foxp3 variants. FOXP3 was screened for functional domains and has a Forkhead (FH) domain in the 295-391 region. Forkhead (FH), also known as a "winged helix" is named for the *Drosophila* fork head protein, a transcription factor which promotes terminal rather than segmental development. This family of transcription factor domains, which bind to B-DNA as monomers, are also found in the Hepatocyte nuclear factor (HNF) proteins, which provide tissue-specific gene regulation. The structure contains 2 flexible loops or "wings" in the C-terminal region, hence the term winged helix. Transmembrane domain prediction with an online transmembrane domain prediction server "DAS" identified no potential transmembrane regions. FOXP3 has high homology (>86%) to the protein sequences of FOXP3 described for mouse and rat. Stock et al. (Stock et al., Nat. Immunol.; 5: 1149-1156 (2004)) described a type of antigen-specific Tr cell that developed in vivo from naive CD4-positive/CD25-negative T cells during a Th1 polarized immune response. These Tr cells were induced by CD8A-positive dendritic cells, produced both IFNG and IL10 and expressed the Th1 'master transcription factor' TBET (TBX21), as well as ICOS and FOXP3. The cells inhibited allergen-induced airway hyperreactivity in an IL10-dependent manner in mice. Stock et al. (Stock et al., Nat. Immunol.; 5: 1149-1156 (2004)) concluded that these adaptive Tr cells are related to, but distinct from, Th1 cells. They proposed that a spectrum of adaptive Tr cell types exists, comprising Th1-like cells and the previously reported Th2-like cells that are induced by CD8A-negative dendritic cells and express the Th2 'master transcription factor' GATA3 and FOXP3.

Suitable MHC ligands/fragments of human FOXP3 can be identified by the method described in connection with the Cologne 1 above.

GNLY:

Human GNLY (granulysin), also known as LAG2, is located in the 85774925-85779380 genomic region on chromosome 2 in the 2p11.2 region. Granulysin is alternatively spliced, resulting in the NKG5 and 519 transcripts. The NKG5 transcript consists of 5 exons resulting after transcription in an mRNA which has 738 base pairs (see SEQ ID NO:47). The actual coding sequence itself consists of 438 base pairs. The translation of this sequence results in a putative protein with a length of 145 amino acids (SEQ ID NO:48). The 519 transcript consists of 5 exons resulting after transcription in an mRNA which has 853 base pairs (see SEQ ID NO:49). The actual coding sequence itself consists of 390 base pairs. The translation of this sequence results in a putative protein with a length of 129 amino acids (SEQ ID NO:50). Granulysin is a protein present in cytotoxic granules of cytotoxic T lymphocytes and natural killer cells. Granulysin is a member of the saposin-like protein (SAPLIP) family and is located in the cytotoxic granules of T cells, which are released upon antigen stimulation. Granulysin has antimicrobial activity against *M. tuberculosis* and other organisms.

GNLY was screened for functional domains and has a Saposin B (SapB) domain in the 46-126 region. Saposins are small lysosomal proteins that serve as activators of various lysosomal lipid-degrading enzymes. They probably act by isolating the lipid substrate from the membrane surroundings, thus making it more accessible to the soluble degradative enzymes. All mammalian saposins are synthesised as a single precursor molecule (prosaposin) which contains four Saposin B domains, yielding the active saposins after proteolytic cleavage, and two Saposin-A domains that are removed in the activation reaction. The Saposin B domains also occur in other proteins, many of them active in the lysis of membranes.

Transmembrane domain prediction with an online transmembrane domain prediction server "DAS" identified 1 potential transmembrane region (5-19) for the NKG5 transcript, whereas for the 519 transcript no transmembrane region could be identified. The GNLY protein has no described homology to the GNLY protein sequences described for mouse and rat.

Suitable MHC ligands/fragments of human GNLY can be identified by the method described in connection with the Cologne 1 above.

ICA1:

Human ICA1 (islet cell autoantigen 1), also known as ICA69, is located in the 8119940-8268710 genomic region on chromosome 7 in the 7p22 region. Alternatively spliced variants which encode different protein isoforms have been described; however, not all variants have been fully characterized. To date for ICA1 2 transcripts have been described. The first transcript consisting of 14 exons resulting after transcription in an mRNA which has 2396 base pairs (see SEQ ID NO:51). The second transcript consists of 14 exons resulting after transcription in an mRNA which has 2268 base pairs (see SEQ ID NO:53). The actual coding sequence of both transcripts consists of 1452 base pairs. The translation of this sequence results in a putative protein with a length of 483 amino acids (SEQ ID NO:54).

ICA1 is found both in the cytosol and as membrane-bound form on the Golgi complex and immature secretory granules. This protein is believed to be an autoantigen in insulin-dependent diabetes mellitus and primary Sjogren's syndrome.

ICA1 was screened for functional domains and has an Arfaptin domain in the 22-249 region. Arfaptin is a ubiquitously expressed protein implicated in mediating cross-talk between Rac, a member of the Rho family, and Arf small GTPases; Arfaptin binds to GTP-bound Arf1 and Arf6, but binds Rac.GTP and Rac.GDP with similar affinities. Structures of Arfaptin with Rac bound to either GDP or the slowly hydrolysable analogue GMPPNP show that the switch regions adopt similar conformations in both complexes. Arf1 and Arf6 are thought to bind to the same surface as Rac. ICA1 additionally has a Islet cell autoantigen ICA69 (ICA69) domain in the 261-483 region. This family includes a 69 kD protein which has been identified as an islet cell autoantigen in type I diabetes mellitus. Its precise function is unknown. Transmembrane domain prediction with an online transmembrane domain prediction server "DAS" identified no potential transmembrane regions. ICA1 has high homology (>89%) to the protein sequences of ICA1 described for mouse and rat. ICA1 is expressed in salivary and lacrimal glands. In NOD mice, in which loss of salivary secretory function develops spontaneously (as in human Sjogren syndrome), Winer et al. (Winer et al., Lancet; 360: 1063-1069 (2002)) found that disruption of the Ica1 gene prevented lacrimal gland disease and greatly reduced salivary gland disease. These animals developed type 1 diabetes with slight delay but at much the same incidence as wildtype animals, assigning a facultative rather than obligate role to ICA1 in the development of diabetes.

Suitable MHC ligands/fragments of human ICA1 can be identified by the method described in connection with the Cologne 1 above.

IL10RA:

Human IL10RA (interleukin 10 receptor, alpha 1) is located in the 117362319-117377404 genomic region on chromosome 11 in the 11q23 region. It consists of 7 exons resulting after transcription in an mRNA which has 3649 base pairs (see SEQ ID NO:57). The actual coding sequence itself consists of 1737 base pairs. The translation of this sequence results in a putative protein with a length of 578 amino acids (SEQ ID NO:58).

The protein encoded by this gene is a receptor for interleukin 10. This protein is structurally related to interferon receptors. It has been shown to mediate the immunosuppressive signal of interleukin 10, and thus inhibits the synthesis of proinflammatory cytokines. This receptor is reported to promote survival of progenitor myeloid cells through the insulin receptor substrate-2/PI 3-kinase/AKT pathway. Activation of this receptor leads to tyrosine phosphorylation of JAK1 and TYK2 kinases.

IL10RA was screened for functional domains and has 2 Fibronectin, type III-like fold domains the 22-124 and 125-235 regions.

Transmembrane domain prediction with an online transmembrane domain prediction server "DAS" identified 2 potential transmembrane regions (5-16 and 232-256). The putative protein shows intermediate homology (~56%) to the protein sequences of IL10RA described for mouse and rat. Interleukin-10 (IL10) is a cytokine produced by B cells, T helper cells, and cells of the monocyte/macrophage lineage that exhibits diverse activities on different cell lines. Tan et al. (Tan et al., J. Biol. Chem.; 268: 21053-21059 (1993)) showed that the protein can be enzymatically iodinated to high specific radioactivity with retention of biologic activity. The radiolabeled ligand was found to bind specifically to its receptor in several mouse and human cell lines. For both mouse and human cell lines examined, there appeared to be at most only a few hundred IL10 receptors per cell. Mouse IL10 was capable of blocking binding of human IL10 to mouse but not human cells. Ho et al. (Ho et al., Proc. Natl. Acad. Sci. USA; 90: 11267-11271 (1993)) found that mouse Il10r is structurally related to interferon receptors. Since IL10 inhibits macrophage activation by interferon-gamma, a possible implication of this relationship is interaction of IL10R and IFN-gamma-R or their signaling pathways.

Suitable MHC ligands/fragments of human IL10RA can be identified by the method described in connection with the Cologne 1 above.

IL7R:

Human IL7R (interleukin 7 receptor), also known as CD127, is located in the 35892748-35915462 genomic region on chromosome 5 in the 5p13 region. It consists of 8 exons resulting after transcription in an mRNA which has 1802 base pairs (see SEQ ID NO:55). The actual coding sequence itself consists of 1380 base pairs. The translation of this sequence results in a putative protein with a length of 459 amino acids (SEQ ID NO:56).

The protein encoded by this gene is a receptor for interleukine 7 (IL7). The function of this receptor requires the interleukin 2 receptor, gamma chain (IL2RG), which is a common gamma chain shared by the receptors of various cytokines, including interleukine 2, 4, 7, 9, and 15. This protein has been shown to play a critical role in the V(D)J recombination during lymphocyte development. This protein is also found to control the accessibility of the TCR gamma locus by STAT5 and histone acetylation. Knockout studies in mice suggested that blocking apoptosis is an essential function of this protein during differentiation and activation of T lymphocytes. The functional defects in this protein may be associated with the pathogenesis of the severe combined immunodeficiency (SCID).

IL7R was screened for functional domains and has a Fibronectin, type III-like fold domain the 125-228 region.

Transmembrane domain prediction with an online transmembrane domain prediction server "DAS" identified 2 potential transmembrane regions (8-18 and 241-264). The putative protein shows intermediate homology (>64%) to the protein sequences of IL7R described for mouse and rat. of this relationship is interaction of IL10R and IFN-gamma-R or their signaling pathways. Reche et al. (Reche et al., J. Immunol.; 167: 336-343 (2001)) showed that expression of thymic stromal lymphopoietin receptor (TSLPR) and IL7R, together but not alone, induced a proliferative response to TSLP, but not to IL7, indicating that the functional TSLP receptor consists of these 2 subunits. PCR analysis of cDNA libraries suggested that DCs and monocytes coexpress IL7R and TSLPR.

Suitable MHC ligands/fragments of human IL7R can be identified by the method described in connection with the Cologne 1 above.

LASS6:

Human LASS6 (LAG1 homolog, ceramide synthase 6 (*S. cerevisiae*)) is located in the 169021081-169339398 genomic region on chromosome 2 in the 2q24.3 region. It consists of 10 exons resulting after transcription in an mRNA which has 6259 base pairs (see SEQ ID NO:61). The actual coding sequence itself consists of 1155 base pairs. The translation of this sequence results in a putative protein with a length of 384 amino acids (SEQ ID NO:62).

LASS6 was screened for functional domains and has a Homeobox domain in the 81-126 region. Homeobox domains are DNA binding domains involved in the transcriptional regulation of key eukaryotic developmental processes and may bind to DNA as monomers or as homo- and/or heterodimers, in a sequence-specific manner. LASS6 additionally has LAG1 domain in the 150-348 region. Members of this family are involved in determining life span. The molecular mechanisms by which LAG1 determines longevity are unclear, although some evidence suggest a participation in ceramide synthesis.

Transmembrane domain prediction with an online transmembrane domain prediction server "DAS" identified 5 to 7 potential transmembrane regions (40-55, 140-149, 182-192 (?) 207-224, 230-237, 261-286, 301-325). LASS6 is therefore a potential multi-pass membrane protein. LASS6 protein has very high homology (>95%) to the protein sequences of LASS6 described for mouse and rat. LASS6 may be involved in sphingolipid synthesis or its regulation (determined by similarity) and is located in the nucleus, the nuclear membrane, the endoplasmic reticulum, and the endoplasmic reticulum membrane.

Suitable MHC ligands/fragments of human LASS6 can be identified by the method described in connection with the Cologne 1 above.

MGST2:

Human MGST2 (microsomal glutathione S-transferase 2), also known as GST2, is located in the 140806372-140844857 genomic region on chromosome 4 in the 4q28.3 region. It consists of 5 exons resulting after transcription in an mRNA which has 801 base pairs (see SEQ ID NO:65). The actual coding sequence itself consists of 444 base pairs. The translation of this sequence results in a putative protein with a length of 147 amino acids (SEQ ID NO:66).

This gene encodes a protein which catalyzes the conjugation of leukotriene A4 and reduced glutathione to produce leukotriene C4.

MGST2 was screened for functional domains and has a Membrane Associated Proteins in Eicosanoid and Glutathione metabolism (MAPEG) domain in the 3-130 region. The MAPEG (Membrane Associated Proteins in Eicosanoid and Glutathione metabolism) family consists of six human proteins, several of which are involved in the production of leukotrienes and prostaglandin E, important mediators of inflammation.

Transmembrane domain prediction with an online transmembrane domain prediction server "DAS" identified 4 potential transmembrane regions (7-15, 60-71, 78-88, 110-127). LASS6 is therefore a potential multi-pass membrane protein. MGST2 protein has very high homology (>95%) to the protein sequences of MGST2 described for mouse and rat. Northern blot analysis found that the gene is expressed as a 0.6-kb transcript in a variety of human tissues, but only weakly expressed (if at all) in lung, brain, placenta, and bone marrow. In contrast, MGST2 mRNA is expressed in lung, various organs of the immune system, and peripheral blood leukocytes.

Suitable MHC ligands/fragments of human MGST2 can be identified by the method described in connection with the Cologne 1 above.

TARP:

Human TARP (TCR gamma alternate reading frame protein), also known as T cell receptor gamma chain, is located in the 38279772-38265768 genomic region on chromosome 7 in the 7p15-p14 region. Isoform a consists of 4 exons resulting after transcription in an mRNA which has 1027 base pairs (see SEQ ID NO:103). The actual coding sequence itself consists of 177 base pairs. The translation of this sequence results in a protein with a length of 58 amino acids (SEQ ID NO:104). Isoform b consists of 4 exons resulting after transcription in an mRNA which has 1027 base pairs. The actual coding sequence itself consists of 336 base pairs. The translation of this sequence results in a protein with a length of 111 amino acids.

In some non-lymphoid tissues, the unrearranged T cell receptor gamma (TRGγ) locus is expressed. The resulting transcript contains a subset of the TRGγ gene segments and is shorter than TRGγ transcripts expressed in lymphoid tissues. This RefSeq record represents the unrearranged TRGγ locus transcript; the complete TRGγ locus is represented by the genomic RefSeq NG_001336. The transcript represented by this RefSeq has two open reading frames (ORFs) that encode different proteins. The downstream ORF is in the same frame as TRGγ and its protein product is similar to TRGγ proteins. The upstream ORF uses a different reading frame and encodes a novel protein.

The protein was screened for functional domains and TARP has no known functional domains. Transmembrane domain prediction with an online transmembrane domain prediction server "DAS" identified for isoform a 2 potential transmembrane regions (8-16, 28-39) whereas the regions from 10-13 and 30-37 had the highest probability and for isoform b one potential transmembrane regions (76-100) whereas the region from 77-99 had the highest probability. The putative protein has high homology (>68%) to the putative protein sequences of TARP described for mouse. This protein is located mainly in the nucleus and mitochondria. Expression analysis in different tissues demonstrated medium level expression in prostate tissue while only low levels or absent expression of TARP was observed in all other tissues analyzed, including bone marrow, liver, heart, spleen, kidney, thymus, skeletal muscle, brain, spinal cord, lung, and pancreas. The TARP gene is embedded within an intron of the T-cell receptor-gamma (TCRG) locus, which encodes an alternative T-cell receptor that is always coexpressed with T-cell receptor-delta (TCRD). Although the TARP and TCRG proteins are distinct, TARP mRNA is detected by cDNA probes that detect TCRG. Unlike TCRG, however, TARP is detected in prostate cancer libraries in the absence of TCRD. TARP is upregulated by androgen (Maeda et al., J. Biol. Chem.; 279: 24561-24568 (2004)). Using subcellular fractionation, immunocytochemistry, and Western blot analysis, Maeda et al. (Maeda et al., J. Biol. Chem.; 279: 24561-24568 (2004)) found that TARP was upregulated by androgen in the mitochondria of prostate cell lines. Fractionation of mitochondria and immunohistochemistry indicated that TARP was located in the outer mitochondrial membrane. Maeda et al. (Maeda et al., J. Biol. Chem.; 279: 24561-24568 (2004)) proposed that TARP may act on mitochondria to carry out its biologic function. Maeda et al. (Maeda et al., J. Biol. Chem.; 279: 24561-24568 (2004)) found that TARP was upregulated by androgen in the mitochondria of prostate cell lines. Fractionation of mitochondria and immunohistochemistry indicated that TARP was located in the outer mitochondrial membrane. Maeda et al. (Maeda et al., J. Biol. Chem.; 279: 24561-24568 (2004)) proposed that TARP may act on mitochondria to carry out its biologic function.

Suitable MHC ligands/fragments of human TARP can be identified by the method described in connection with the Cologne 1 above.

RBMS1:

Human RBMS1 (RNA binding motif, single stranded interacting protein 1) is located in the 16058550-160838757 genomic region on chromosome 2 in the 2q24.2 region. Isoform a consists of 11 exons resulting after transcription in an mRNA which has 2438 base pairs (see SEQ ID NO:81). The actual coding sequence itself consists of 1221 base pairs. The translation of this sequence results in a protein with a length of 406 amino acids (SEQ ID NO:82). Isoform b consists of 12 exons resulting after transcription in an mRNA which has 2596 base pairs (see SEQ ID NO:83). The actual coding sequence itself consists of 1170 base pairs. The translation of this sequence results in a protein with a length of 389 amino acids (SEQ ID NO:84). Isoform c consists of 11 exons resulting after transcription in an mRNA which has 2429 base pairs (see SEQ ID NO:85). The actual coding sequence itself consists of 1212 base pairs. The translation of this sequence results in a putative protein with a length of 403 amino acids (SEQ ID NO:86).

RBMS encode a number of a small family of proteins which bind single stranded DNA/RNA. These proteins are characterized by the presence of two sets of ribonucleoprotein consensus sequence (RNP-CS) that contain conserved motifs, RNP1 and RNP2, originally described in RNA binding proteins, and required for DNA binding. These proteins have been implicated in such diverse functions as DNA replication, gene transcription, cell cycle progression and apoptosis. Multiple transcript variants, resulting from alternative splicing and encoding different isoforms, have been described. Several of these were isolated by virtue of their binding to either strand of an upstream element of c-myc (MSSPs), or by phenotypic complementation of cdc2 and cdc13 mutants of yeast (scr2), or as a potential human repressor of HIV-1 and ILR-2 alpha promoter transcription (YC1). A pseudogene for this locus is found on chromosome 12.

The protein was screened for functional domains and RBMS1 has 2 RNA recognition motifs in the 63-131 and 142-213 region. Many eukaryotic proteins that are known or supposed to bind single-stranded RNA contain one or more copies of a putative RNA-binding domain of about 90 amino acids. This is known as the eukaryotic putative RNA-binding region RNP-1 signature or RNA recognition motif (RRM). RRMs are found in a variety of RNA binding proteins, including heterogeneous nuclear ribonucleoproteins (hnRNPs), proteins implicated in regulation of alternative splicing, and protein components of small nuclear ribonucleoproteins (snRNPs). The motif also appears in a few single stranded DNA binding proteins. The RRM structure consists of four strands and two helices arranged in an alpha/beta sandwich, with a third helix present during RNA binding in some cases. Two individual models were built which identify subtypes of this domain, but there is no functional difference between the subtypes. Transmembrane domain prediction with an online transmembrane domain prediction server "DAS" identified no potential transmembrane regions. The protein has high homology (>96%) to the protein sequences of RBMS1 described for mouse and rat. This protein is located mainly in the nucleus. Expression analysis in different tissues demonstrated medium level expression in lung and kidney tissue while only low levels or absent expression of Cologne 2 was observed in all other tissues analyzed, including bone marrow, liver, heart, spleen, thymus, skeletal muscle, brain, spinal cord, prostate, and pancreas.

Suitable MHC ligands/fragments of the human RBMS1 protein can be identified by the method described in connection with the Cologne 1 above.

NCF4:

Human NCF4 (neutrophil cytosolic factor 4, 40 kDa) is located in the 35586990-35604004 genomic region on chromosome 22 in the 22q13.1 region. Isoform a consists of 9 exons resulting after transcription in an mRNA which has 1386 base pairs (see SEQ ID NO:67). The actual coding sequence itself consists of 1020 base pairs. The translation of this sequence results in a protein with a length of 339 amino acids (SEQ ID NO:68). Isoform b consists of 10 exons resulting after transcription in an mRNA which has 1631 base pairs (see SEQ ID NO:69). The actual coding sequence itself consists of 1047 base pairs. The translation of this sequence results in a protein with a length of 348 amino acids (SEQ ID NO:70).

The protein was screened for functional domains and NCF4 has a PhoX homologous domain in the 19-140 region, which is an eukaryotic domain of unknown function present in phox proteins. The PX (phox) domain occurs in a variety of eukaryotic proteins and have been implicated in highly diverse functions such as cell signalling, vesicular trafficking, protein sorting and lipid modification. PX domains are important phosphoinositide-binding modules that have varying lipid-binding specificities. The PX domain is approximately 120 residues long and folds into a three-stranded beta-sheet followed by three-helices and a proline-rich region that immediately preceeds a membrane-interaction loop and spans approximately eight hydrophobic and polar residues. The PX domain of p47phox binds to the SH3 domain in the same protein. Phosphorylation of p47(phox), a cytoplasmic activator of the microbicidal phagocyte oxidase (phox), elicits interaction of p47(phox) with phoinositides. The protein phosphorylation-driven conformational change of p47(phox) enables its PX domain to bind to phosphoinositides, the interaction of which plays a crucial role in recruitment of p47 (phox) from the cytoplasm to membranes and subsequent activation of the phagocyte oxidase. The lipid-binding activity of this protein is normally suppressed by intramolecular interaction of the PX domain with the C-terminal Src homology 3 (SH3) domain. The PX domain is conserved from yeast to human. A recent multiple alignment of representative PX domain sequences can be found in although showing relatively little sequence conservation, their structure appears to be highly conserved. Although phosphatidylinositol-3-phosphate (PtdIns(3)P) is the primary target of PX domains, binding to phosphatidic acid, phosphatidylinositol-3,4-bisphosphate (PtdIns(3,4)P2), phosphatidylinositol-3,5-bisphosphate (PtdIns(3,5)P2), phosphatidylinositol-4,5-bisphosphate (PtdIns(4,5)P2), and phosphatidylinositol-3,4,5-trisphosphate (PtdIns(3,4,5)P3) has been reported as well. The PX-domain is also a protein-protein interaction domain. NCF4 additionally has a Src homology 3 domain in the 175-226 region, which binds to target proteins through sequences containing proline and hydrophobic amino acids. Pro-containing polypeptides may bind to SH3 domains in 2 different binding orientations. SH3 (src Homology-3) domains are small protein modules containing approximately 50 amino acid residues. They are found in a great variety of intracellular or membrane-associated proteins for example, in a variety of proteins with enzymatic activity, in adaptor proteins that lack catalytic sequences and in cytoskeletal proteins, such as fodrin and yeast actin binding protein ABP-1. The SH3 domain has a characteristic fold which consists of five or six beta-strands arranged as two tightly packed anti-parallel beta sheets. The linker regions may contain short helices. The surface of the SH2-domain bears a flat, hydrophobic ligand-binding pocket which consists of three shallow grooves defined by conservative aromatic residues in which the ligand adopts an extended left-handed helical arrangement. The ligand binds with low affinity but this may be enhanced by multiple interactions. The region bound by the SH3 domain is in all cases proline-rich and contains PXXP as a core-conserved binding motif. The function of the SH3 domain is not well understood but they may mediate many diverse processes such as increasing local concentration of proteins, altering their subcellular location and mediating the assembly of large multiprotein complexes. In addition, NCF4 has a nuclear localization signal in the 148-158 region. Classical nuclear localization signal (NLS) sequences incorporate regions enriched in basic amino acids and generally conform to one of three motifs. The "pat4" NLS consists of a continuous stretch of four basic amino acids (lysine or arginine) or three basic amino acids associated with histidine or proline. The "pat7" NLS starts with a proline and is followed within three residues by an amino acid sequence containing three basic residues out of four. The third type of NLS, known as a "bipartite" motif, consists of two basic amino acids, a 10 amino acid spacer and a five amino acid sequence containing at least three basic residues. Transmembrane domain prediction with an online transmembrane domain prediction server "DAS" identified 4 potential transmembrane regions (39-42, 115-124, 196-200, 218-224) whereas the region from 117-119 had the highest probability. The protein has high homology (>75%) to the protein sequences of NCF4 described for mouse and rat. This protein is located mainly in the cytoplasm. Expression analysis in different tissues demonstrated medium level expression in bone marrow, spleen, and lung tissue while only low levels or absent expression of tNCF4 was observed in all other tissues analyzed.

Suitable MHC ligands/fragments of the human NCF4 proteins can be identified by the method described in connection with the Cologne 1 above.

PTTG3:

Human PTTG3 (pituitary tumor-transforming 3) is located in the 67842186-67842794 genomic region on chromosome 8 in the 8q13.1 region. It consists of 1 exon resulting after transcription in an mRNA which has 609 base pairs (see SEQ ID NO:77). The translation of this sequence results in a putative protein with a length of 202 amino acids (SEQ ID NO:78).

PTTG3 was screened for functional domains and has a Securin sister-chromatid separation inhibitor domain in the 1-191 region. Securin, also known as pituitary tumour-transforming gene product is a regulatory protein which plays a central role in chromosome stability in the p53/TP53 pathway, and in DNA repair. It probably acts by blocking the action of key proteins, for example, during mitosis it blocks Separase/ESPL1 function preventing the proteolysis of the cohesin complex and the subsequent segregation of the chromosomes. At the onset of anaphase, it is ubiquitinated, leading to its destruction and to the liberation of ESPL1. Its function is however not limited to an inhibitory activity, since it is required to activate ESPL1. The negative regulation of the transcriptional activity and related apoptosis activity of TP53 may explain the strong transforming capability of the protein when it is overexpressed. Over-expression of securin is associated with a number of tumours, and it has been proposed that this may be due to erroneous chromatid separation leading to chromosome gain or loss. Transmembrane domain prediction with an online transmembrane domain prediction server "DAS" identified 1 potential transmembrane regions (181-191). No homologies have been decribed for protein sequences of PTTG3 described for mouse and rat.

Suitable MHC ligands/fragments of human PTTG3 can be identified by the method described in connection with the Cologne 1 above.

FAM129A:

Human FAM129A (family with sequence similarity 129, member A), also known as NIBAN or C1orf24, is located in the 183026787-183210305 genomic region on chromosome 1 in the 8q13.1 region. It consists of 14 exons resulting after transcription in an mRNA which has 6928 base pairs (see SEQ ID NO:37). The actual coding sequence itself consists of 2787 base pairs. The translation of this sequence results in a putative protein with a length of 928 amino acids (SEQ ID NO:38).

FAM129A was screened for functional domains. No functional domains were identified Transmembrane domain prediction with an online transmembrane domain prediction server "DAS" identified no potential transmembrane regions. The putative protein has intermediate homology (>71%) to the protein sequences of FAM129A described for mouse and rat. FAM129A expression is up-regulated in various types of thyroid tumors.

Suitable MHC ligands/fragments of human FAM129A can be identified by the method described in connection with the Cologne 1 above.

KIAA1600:

Human KIAA1600, also known as hypothetical protein LOC57700, is located in the 116571493-116649581 genomic region on chromosome 10 in the 1q25 region. It consists of 17 exons resulting after transcription in an mRNA which has 5806 base pairs (see SEQ ID NO:59). The actual coding sequence itself consists of 2298 base pairs. The translation of this sequence results in a putative protein with a length of 765 amino acids (SEQ ID NO:60).

The protein was screened for functional domains and for KIAA1600 no functional domains were detected. Transmembrane domain prediction with an online transmembrane domain prediction server "DAS" identified 1 potential transmembrane regions (689-701). The putative protein has high homology (>92%) to the putative protein sequences of KIAA1600 described for mouse and rat.

Suitable MHC ligands/fragments of human KIAA1600 can be identified by the method described in connection with the Cologne 1 above.

C6ORF190:

Human C6ORF190 (chromosome 6 open reading frame 190), also known as C6orf207, is located in the 128065879-128281435 genomic region on chromosome 6 in the 6q22.33 region. C6ORF190 exists in 3 transcript variants. The first variant consists of 7 exons resulting after transcription in an mRNA which has 2248 base pairs (SEQ ID NO:735). The translation of this sequence results in a putative protein with a length of 643 amino acids (SEQ ID NO:736). The second variant consists of 7 exons resulting after transcription in an mRNA which has 4029 base pairs. The actual coding sequence itself consists of 1926 base pairs. The translation of this sequence results in a putative protein with a length of 641 amino acids. The third transcript consists of 7 exons resulting after transcription in an mRNA which has 4101 base pairs.

The translation of this sequence results in a putative protein with a length of 562 amino acids.

All transcripts of C6ORF190 were screened for functional domains. None of the three transcripts contains any functional domains. Transmembrane domain prediction with an online transmembrane domain prediction server "DAS" identified no potential transmembrane regions. The putative protein has high homology (>81%) to the putative protein sequences of E430004N04Rik described for mouse. No homologies are described for rat.

Suitable MHC ligands/fragments of the human C6ORF190 proteins can be identified by the method described in connection with the Cologne 1 above.

MGC33556:

Human MGC33556, also known as hypothetical LOC339541, is located in the 44912981-44963848 genomic region on chromosome 1 in the 1p34.1 region. MGC33556 consists of 10 exons resulting after transcription in an mRNA which has 2113 base pairs (see SEQ ID NO:63). The actual coding sequence itself consists of 924 base pairs. The translation of this sequence results in a putative protein with a length of 307 amino acids (SEQ ID NO:64). MGC33556 was screened for functional domains, but no functional domains were detected. Transmembrane domain prediction with an online transmembrane domain prediction server "DAS" identified 2 potential transmembrane regions (140-152, 298-308). The putative protein has high homology (>82%) to the putative protein sequences of Gm1661 described for mouse and RGD1563714_predicted for rat.

Suitable MHC ligands/fragments of human MGC33556 can be identified by the method described in connection with the Cologne 1 above.

NELL2:

Human NELL2 (NEL-like 2 (chicken)), also known as neural epidermal growth factor-like 2, is located in the 43556404-43188331 genomic region on chromosome 12 in the 12q13.11-q13.12 region. It consists of 13 exons resulting after transcription in an mRNA which has 3198 base pairs (see SEQ ID NO:71). The actual coding sequence itself consists of 2451 base pairs. The translation of this sequence results in a putative protein with a length of 816 amino acids (SEQ ID NO:72).

This gene encodes a cytoplasmic protein that contains epidermal growth factor (EGF)-like repeats. The encoded heterotrimeric protein may be involved in cell growth regulation and differentiation. A similar protein in rodents is involved in craniosynostosis. An alternative splice variant has been described but its full length sequence has not been determined.

The protein was screened for functional domains and NELL2 has 2 von Willebrand factor (vWF) type C domains in the 274-330 and 700-755 region. The vWF domain is found in various plasma proteins: complement factors B, C2, CR3 and CR4; the integrins (I-domains); collagen types VI, VII, XII and XIV; and other extracellular proteins. Although the majority of VWA-containing proteins are extracellular, the most ancient ones present in all eukaryotes are all intracellular proteins involved in functions such as transcription, DNA repair, ribosomal and membrane transport and the proteasome. A common feature appears to be involvement in multiprotein complexes. Proteins that incorporate vWF domains participate in numerous biological events (e.g. cell adhesion, migration, homing, pattern formation, and signal transduction), involving interaction with a large array of ligands. A number of human diseases arise from mutations in VWA domains. Secondary structure prediction from 75 aligned vWF sequences has revealed a largely alternating sequence of alpha-helices and beta-strands. The domain is named after the von Willebrand factor (VWF) type C repeat which is found in multidomain protein/multifunctional proteins involved in maintaining homeostasis. For the von Willebrand factor the duplicated VWFC domain is thought to participate in oligomerization, but not in the initial dimerization step. The presence of this region in a number of other complex-forming proteins points to the possible involvment of the VWFC domain in complex formation. In addition, NELL 2 has 6 EGF-like domains in the 395-438, 440-480, 486-521, 525-552, 555-591, and 602-640 region. Furthermore, NELL2 has a Coiled Coil domain in the 237-368 region. Coiled coil is a protein domain that forms a bundle of two or three alpha helices. Short coiled coil domains are involved in protein interactions but long coiled coil domains which from long rods occur in structural or motor proteins. Transmembrane domain prediction with an online transmembrane domain prediction server "DAS" identified 4 potential transmembrane regions (7-24, 100-106, 155-164, 210-213) whereas the regions from 9-21 and 158-162 had the highest probability. The putative protein has high homology (>93%) to the putative protein sequences of NELL described for mouse and rat. This protein is located mainly in the cytoplasm. Expression analysis in different tissues demonstrated medium level expression in brain, thymus, spleen, and lung tissue while only low levels or absent expression of NELL2 was observed in all other tissues analyzed. Proteins containing epidermal growth factor (EGF)-like repeats are often involved in growth regulation and differentiation.

Suitable MHC ligands/fragments of human NELL2 can be identified by the method described in connection with the Cologne 1 above.

PTPLA:

Human PTPLA (protein tyrosine phosphatase-like) is located in the 17699378-17671963 genomic region on chromosome 10 in the 10p14-p13 region. It consists of 6 exons resulting after transcription in an mRNA which has 1323 base pairs (see SEQ ID NO:73). The actual coding sequence itself consists of 867 base pairs. The translation of this sequence results in a putative protein with a length of 288 amino acids (SEQ ID NO:74).

The protein encoded by this gene contains a characteristic catalytic motif of the protein tyrosine phosphatases (PTPs) family. The PTP motif of this protein has the highly conserved arginine residue replaced by a proline residue; thus it may represent a distinct class of PTPs. Members of the PTP family are known to be signaling molecules that regulate a variety of cellular processes. This gene was preferentially expressed in both adult and fetal heart. A much lower expression level was detected in skeletal and smooth muscle tissues, and no expression was observed in other tissues. The tissue specific expression in the developing and adult heart suggests a role in regulating cardiac development and differentiation. The protein was screened for functional domains and PTPLA has 4 transmembrane domains in the 68-90, 121-143, 206-228, and 248-270 region. Transmembrane domains are composed of 15-30 hydrophobic residues and are found in proteins that span a membrane in a cell. A protein can have a single TM domain (e.g. Type I transmembrane receptors such as EGF receptor) or multiple TM domains (e.g. G-protein coupled receptors). To span the hydrocarbon core of the membrane of ~3 nm requires an alpha helix of ~20 uncharged predominantly apolar residues. Membrane separates two aqueous compartments by a thin two dimensional lipid phase. Membrane proteins generally span this lipid phase and therefore needed to accomodate to the hydrophilic stretch on both sides of the membrane as well as to the hydrophobic environment in the core of the bilayer. The structure of the membrane embedded portions consist of either of transmembrane alpha helices often assembled in to helix bundles or of antiparralel beta sheets forming barrel shaped pores. The length of the transmembrane helix may even correlate with the thickness of its membrane. Single spanning membrane proteins of the Endoplasmic reticulum (ER) and Golgi generally have shorter transmembrane domains than plasma membrane proteins. Since cholestrol content and thus the thickness of the lipid bilayer also increases along with the secretory pathway, this might reflect a role of the transmembrane segments and proteins in lipid sorting. In multi spanning membrane proteins the transmembrane helices are tightly bundled to compact, globular structure from which lipids are excluded. The protein has high homology (>86%) to the protein sequences of PTPLA described for mouse and rat. This protein is located mainly in membranes. Expression analysis in different tissues demonstrated medium level expression in heart tissue and smooth muscle cells while only low levels or absent expression of PTPLA was observed in all other tissues analyzed. Protein tyrosine phosphatases (PTPs) mediate the dephosphorylation of phosphotyrosine. PTPs are known to be involved in many signal transduction pathways leading to cell growth, differentiation, and oncogenic transformation. PTPLA is a PTP-like protein that contains the conserved catalytic site of PTP proteins but with a proline residue in place of a conserved arginine residue (Uwanogho et al., Genomics; 62: 406-416 (1999)). It is suggested that the substitution of an essential arginine by proline within the presumed active site of PTPLA may render the protein inactive, making PTPLA an antiphosphatase that competitively antagonizes PTPs.

Suitable MHC ligands/fragments of human PTPLA can be identified by the method described in connection with the Cologne 1 above.

PTTG1:

Human PTTG1 (pituitary tumor-transforming 1) is located in the 159781442-159788323 genomic region on chromosome 5 in the 5q35.1 region. It consists of 6 exons resulting after transcription in an mRNA which has 728 base pairs (see SEQ ID NO:75). The actual coding sequence itself consists of 609 base pairs. The translation of this sequence results in a putative protein with a length of 202 amino acids (SEQ ID NO:76).

PTTG1 is a homolog of yeast securin proteins, which prevent separins from promoting sister chromatid separation. It is an anaphase-promoting complex (APC) substrate that associates with a separin until activation of the APC. The gene product has transforming activity in vitro and tumorigenic activity in vivo, and the gene is highly expressed in various tumors. The gene product contains 2 PXXP motifs, which are required for its transforming and tumorigenic activities, as well as for its stimulation of basic fibroblast growth factor expression. It also contains a destruction box (D box) that is required for its degradation by the APC. The acidic C-terminal region of the encoded protein can act as a transactivation domain. The gene product is mainly a cytosolic protein, although it partially localizes in the nucleus.

The protein was screened for functional domains and PTTG1 has an N-terminal basic domain and a C-terminal acidic domain and is a proline-rich protein with several putative SH3-binding sites. Transmembrane domain prediction with an online transmembrane domain prediction server "DAS" identified 2 potential transmembrane regions (140-146, 185-187). The protein has high homology (>72%) to the protein sequences of PTTG1 described for mouse and rat. This protein is located mainly in the cytoplasm and nucleus. Expression analysis in different tissues demonstrated medium level expression in bone marrow, testis, and thymus tissue while only low levels or absent expression of PTTG1 was observed in all other tissues analyzed, including lung, liver, heart, spleen, kidney, skeletal muscle, brain, spinal cord, prostate, and pancreas. Kakar (Kakar, Cytogenet Cell. Genet.; 83: 93-95 (1998)) found that overexpression of PTTG1 in mouse fibroblast NIH3T3 cells resulted in an increase in cell proliferation and cellular transformation. Injection of transfected NIH3T3 cells into nude mice resulted in tumor formation, indicating that PTTG1 is tumorigenic. Zhang et al. (Zhang et al., Mol. Endocrinol.; 13: 156-166 (1999)) mutated the proline residues of the SH3 domain-binding sites of PTTG1 and observed that the in vitro transforming and in vivo tumor-inducing activity, as well as the stimulation of basic fibroblast growth factor (FGFB), was abrogated. Zhang et al. (Zhang et al., Mol. Endocrinol.; 13: 156-166 (1999)) concluded that human PTTG1 functions through SH3-mediated signal transduction pathways and activation of growth factors. As PTTG1 appeared to be an anaphase-promoting complex (APC) substrate that associated with ESP1 until activation of the APC, Zou et al. (Zou et al., Science; 285: 418-422 (1999)) identified PTTG1 as the human securin. Zou et al. (Zou et al., Science; 285: 418-422 (1999)) observed sequence similarity among the vertebrate securins throughout the entire sequence. A conserved motif in the PTTG1 protein matches the destruction box (D box) shared by many APC substrates. Like other securins, PTTG1 contains clusters of acidic and basic domains. The N-terminal half is rich in lysine residues surrounding the D box. This is common for D box-containing APC substrates, presumably because lysine is the residue that forms a covalent isopeptide linkage with ubiquitin. Zou et al. (Zou et al., Science; 285: 418-422 (1999)) found that human securin begins to accumulate at the onset of S phase and peaks at the G2-M phases in parallel with cyclin B1 (123836). Its level drops precipitously when APC is activated, indicated by the decline of cyclin B1. Zou et al. (Zou et al., Science; 285: 418-422 (1999)) mutated the RKAL residues of the securin D box to AKAA and found that the mutant securin was stable in mitotic extracts, confirming that the RKAL sequence is required for degradation. Zou et al. (Zou et al., Science; 285: 418-422 (1999)) concluded that identification of human securin as an oncogene suggests that misregulation of chromatid separation may contribute to the generation of malignant tumors.

Suitable MHC ligands/fragments of human PTTG1 can be identified by the method described in connection with the Cologne 1 above.

RAB6IP1:

Human RAB6IP1 (RAB6 interacting protein 1) is located in the 9243446-9116947 genomic region on chromosome 11 in the 11p15.4 region. It consists of 17 exons resulting after transcription in an mRNA which has 4965 base pairs (see SEQ ID NO:79). The actual coding sequence itself consists of 3864 base pairs. The translation of this sequence results in a putative protein with a length of 1287 amino acids (SEQ ID NO:80).

The protein was screened for functional domains and RAB6IP1 has a Lipoxygenase homology 2 (beta barrel) domain in the 957-1059 region. This domain is found in a variety of membrane or lipid associated proteins. It is present in lipogenases, enzymes involved at various steps in the biosynthesis of leukotrienes with iron as the cofactor. The known structure of pancreatic lipase shows this domain binds to procolipase that mediates membrane association. This domain may mediate membrane attachment via other protein binding partners. The structure of this domain is known for many members of the family and is composed of a beta sandwich. RAB6IP1 additionally has an N-terminal signal peptide domain in the 1-48 region. It is usually located at the N terminus and normally absent from the mature protein. Normally refers to the sequence (ca. 20 amino acids) that interacts with signal recognition particle and directs the ribosome to the endoplasmic reticulum where co translational insertion takes place. Signal peptides are highly hydrophobic but with some positively charged residues. The signal sequence is normally removed from the growing peptide chain by signal peptidase, a specific protease located on the cisternal face of the endoplasmic reticulum. Transmembrane domain prediction with an online transmembrane domain prediction server "DAS" identified 12 potential transmembrane regions (21, 205-212, 298-311, 327-331, 342-354, 795-797, 799-799, 936-939, 943-961, 1135-1143, 1234-1239, 1260-1266) whereas the regions from 207-209, 305-307, 345-350, and 948-959 had the highest probability. The protein has high homology (>97%) to the protein sequences of RAB6IP1 described for mouse and rat. The localization of this protein is unknown. Expression analysis in different tissues demonstrated medium level expression in almost all tissues analyzed, including bone marrow, liver, lung, heart, spleen, kidney, thymus, skeletal muscle, brain, spinal cord, prostate, and pancreas.

Suitable MHC ligands/fragments of human RAB6IP1 can be identified by the method described in connection with the Cologne 1 above.

RHOU:

Human RHOU (ras homolog gene family, member U) is located in the 226937491-226949033 genomic region on chromosome 1 in the 1q42.11-q42.3 region. It consists of 3 exons resulting after transcription in an mRNA which has 4369 base pairs (see SEQ ID NO:87). The actual coding sequence itself consists of 777 base pairs. The translation of this sequence results in a putative protein with a length of 258 amino acids (SEQ ID NO:88).

RHOU encodes a member of the Rho family of GTPases. This protein can activate PAK1 and JNK1, and can induce filopodium formation and stress fiber dissolution. It may also mediate the effects of WNT1 signaling in the regulation of cell morphology, cytoskeletal organization, and cell proliferation.

The protein was screened for functional domains and RHOU has Rho (Ras homology) subfamily of Ras-like small GTPases domain in the 52-225 region. Small GTPases are involved in intracellular cell signalling processes. The Ras family includes a large number of small GTPases. Transmembrane domain prediction with an online transmembrane domain prediction server "DAS" identified 7 potential transmembrane regions (53-56, 58-61, 63-67, 88-90, 121-133, 156-159, 217-222) whereas the region from 122-132 had the highest probability. The protein has high homology (>93%) to the protein sequences of RHOU described for mouse. This protein is located mainly in the cytoplasm. RHOU has features conserved among members of the Rho family of GTPases including GTP and GDP binding domains, the effector domain, and a CAAX lipid modification signal in the C terminus. It has a unique N-terminal domain containing several putative PXXP SH3-binding motifs. RHOU is expressed in brain, skeletal muscle, and placenta, with moderate expression in liver, lung, and heart, and low expression in colon, spleen, kidney, and small intestine. Tao et al. (Tao et al., Genes Dev.; 15: 1796-1807 (2001)) demonstrated that RHOU, like CDC42, can activate PAK1 and JNK1 (MAPK8) and can induce filopodium formation and stress fiber dissolution. Active RHOU stimulated quiescent cells to reenter the cell cycle. Overexpression of RHOU in mouse mammary epithelial cells induced morphologic transformation that mimics Wnt1-induced transformation. Tao et al. (Tao et al., Genes Dev.; 15: 1796-1807 (2001)) hypothesized that RHOU could mediate the effects of WNT1 signaling in the regulation of cell morphology, cytoskeletal organization, and cell proliferation.

Suitable MHC ligands/fragments of human RHOU can be identified by the method described in connection with the Cologne 1 above.

SATB1:

Human SATB1 (SATB homeobox 1), also known as special AT-rich sequence binding protein 1, is located in the 18440343-18364437 genomic region on chromosome 3 in the 3p23 region. It consists of 11 exons resulting after transcription in an mRNA which has 6659 base pairs (see SEQ ID NO:89). The actual coding sequence itself consists of 2292 base pairs. The translation of this sequence results in a putative protein with a length of 763 amino acids (SEQ ID NO:90).

The protein was screened for functional domains and SATB1 has a homeobox domain (HOX) in the 644-707 region, which are often DNA-binding factors that are involved in the transcriptional regulation of key developmental processes. The homeobox domain was first identified in a number of *drosophila* homeotic and segmentation proteins, but is now known to be well-conserved in many other animals, including vertebrates. HOX genes encode homeodomain-containing transcriptional regulators that operate differential genetic programs along the anterior-posterior axis of animal bodies. The domain binds DNA through a helix-turn-helix (HTH) structure. The HTH motif is characterised by two alpha-helices, which make intimate contacts with the DNA and are joined by a short turn. The second helix binds to DNA via a number of hydrogen bonds and hydrophobic interactions, which occur between specific side chains and the exposed bases and thymine methyl groups within the major groove of the DNA. The first helix helps to stabilise the structure. The motif is very similar in sequence and structure in a wide range of DNA-binding proteins (e.g., cro and repressor proteins, homeotic proteins, etc.). One of the principal differences between HTH motifs in these different proteins arises from the stereo-chemical requirement for glycine in the turn which is needed to avoid steric interference of the beta-carbon with the main chain: for cro and repressor proteins the glycine appears to be mandatory, while for many of the homeotic and other DNA-binding proteins the requirement is relaxed. Transmembrane domain prediction with an online transmembrane domain prediction server "DAS" identified 6 potential transmembrane regions (74-79, 110-119, 163-165, 217-220, 392-392, 655-663) whereas the region from 114-114 had the highest probability. The protein has high homology (>98%) to the protein sequences of SATB1 described for mouse and rat. Several splice variants are characterized and additionally they show selective expression of this gene in resting $CD4^+$ T cells. This protein is located mainly in the nucleus. Expression analysis in different tissues demonstrated medium level expression in the thymus, testis and Th2 cells while only low levels or absent expression of SATB1 was observed in all other tissues analyzed. SATB1 is a matrix protein binding specifically to the nuclear matrix/scaffold-associating DNAs (MARs/SARs), control elements maintaining independent realms of gene activity. Dickinson et al. (Dickinson et al., Cell; 70: 631-645 (1992)) cloned a human cDNA that encodes SATB1. It is expressed predominantly in the thymus. SATB1 selectively binds double-stranded, special AT-rich DNA sequences in which 1 strand exclusively consists of well-mixed A, T, and C nucleotides (ATC sequences). Yasui et al. (Yasui et al., Nature; 419: 641-645 (2002)) noted that ablation of Satb1 in mice by gene targeting results in temporal and spatial misexpression of numerous genes and arrested T-cell development, suggesting that Satb1 is a cell-type-specific global gene regulator. They found that Satb1 coimmunoprecipitated with several chromatin remodeling factors in a large protein complex that was not observed in Satb1 null thymic extracts. Yasui et al. (Yasui et al., Nature; 419: 641-645 (2002)) examined the role of Satb1 in the expression of the interleukin-2 receptor-alpha gene (IL2RA), which is ectopically transcribed in Satb1 null thymocytes. Satb1 recruited the histone deacetylase (HDAC1) contained within the NURD chromatin remodeling complex to an Satb1-bound site in the Il2ra locus and mediated the specific deacetylation of histones in a large domain within the locus. Satb1 also targeted the Acf1 (BAZ1A) and Iswi (SMARCA5) subunits of the CHRAC and ACF nucleosome mobilizing complexes to this specific site and regulated nucleosome positioning over several kilobases. Eukaryotic chromosomes are packaged in nuclei by many orders of folding. Higher-order chromatin packaging may affect gene expression. SATB1 is a cell-type specific nuclear protein that recruits chromatin remodeling factors and regulates numerous genes during thymocyte differentiation. Cai et al. (Cai et al., Nat. Genet.; 34: 42-51 (2003)) showed that in thymocyte nuclei, SATB1 has a cage-like 'network' distribution circumscribing heterochromatin and selectively tethers specialized DNA sequences onto its network. This was shown by fluorescence in situ hybridization on wildtype and Satb1-null thymocytes using in vivo SATB1-bound sequences as probes. Many gene loci, including that of MYC and a brain-specific gene, are anchored by the SATB1 network at specific genomic sites, and this phenomenon is precisely correlated with proper regulation of distant genes. Histone-modification analyses across a gene-enriched genomic region of 70 kb showed that acetylation of histone H3 at lys9 and lys14 peaks at the SATB1-binding site and extends over a region of roughly 10 kb covering genes regulated by SATB1. By contrast, in Satb1-null thymocytes, this site is marked by methylation at H3 lys9. Cai et al. (Cai et al., Nat. Genet; 34: 42-51 (2003)) proposed that SATB1 is a new type of gene regulator with a novel nuclear architecture, providing sites for tissue-specific organization of DNA sequences and regulating region-specific histone modification. Kumar et al. (Kumar et al., Nat. Cell Biol; 9: 45-56 (2007)) showed that phosphorylation of SATB1 on ser185 by PKC (PRKCA) acted as a switch to determine whether SATB1 interacted with HDAC1 or PCAF in human cell lines. Phosphorylation and dephosphorylation of SATB1 exerted opposite effects on reporter gene activity. SATB1 interacted with both the CBP (CREBBP)-p300 (EP300) dimer and with PCAF. The SATB1-PCAF interaction allowed PCAF to acetylate lys136 within the PDZ-like domain of SATB1, which led to loss of SATB1 DNA-binding activity and altered gene expression at a global level. Cai et al. (Cai et al., Nat. Genet; 38: 1278-1288 (2006)) found that upon T helper-2 (Th2) cell activation in mice, Satb1 expression was rapidly induced to form a transcriptionally active chromatin structure at the 200-kb Th2 cytokine locus on chromosome 11. In this structure, chromatin was folded into numerous small loops, all anchored to Satb1 at their base. Before activation, the Th2 cytokine locus was already associated with Gata3 and Stat6, showing some looping, but these were insufficient to induce cytokine gene expression. Using RNA interference, Cai et al. (Cai et al., Nat. Genet.; 38: 1278-1288 (2006)) showed that on cell activation, Satb1 was required not only for compacting chromatin into dense loops at the cytokine locus, but also for inducing expression of Il4, Il5, Il13, and Maf.

Suitable MHC ligands/fragments of human SATB1 can be identified by the method described in connection with the Cologne 1 above.

SELP:

Human SELP (selectin P (granule membrane protein 140 kDa, antigen CD62)) is located in the 167866030-167824713 genomic region on chromosome 1 in the 1q22-q25 region. It consists of 17 exons resulting after transcription in an mRNA which has 3199 base pairs (see SEQ ID NO:91). The actual coding sequence itself consists of 3493 base pairs. The translation of this sequence results in a putative protein with a length of 830 amino acids (SEQ ID NO:92).

SELP is a platelet alpha-granule membrane protein of molecular weight 140,000 that redistributes to the plasma membrane during platelet activation and degranulation. It is a member of a family of adhesion/homing receptors. Alternative splice variants may occur but are not well documented.

The protein was screened for functional domains and SELP has a C-type lectin (CTL) domain in the 30-159 region, which often function as calcium-dependent carbohydrate binding modules. Animal lectins display a wide variety of architectures. They are classified according to the carbohydrate-recognition domain (CRD) of which there are two main types, S-type and C-type. C-type lectins display a wide range of specificities. They require Ca2+ for their activity They are found predominantly but not exclusively in vertebrates. In addition SELP has an epidermal-growth factor-like domain in the 162-195 region. Epidermal growth factors and transforming growth factors belong to a general class of proteins that share a repeat pattern involving a number of conserved Cys residues. Growth factors are involved in cell recognition and division. The repeating pattern, especially of cysteines (the so-called EGF repeat), is thought to be important to the 3D structure of the proteins, and hence its recognition by receptors and other molecules. The type 1 EGF signature includes six conserved cysteines believed to be involved in disulphide bond formation. The EGF motif is found frequently in nature, particularly in extracellular proteins. Furthermore, SELP has 9 sushi domains in the 200-257, 262-319, 324-381, 386-443, 448-505, 510-567, 572-629, 642-699, and 704-761 regions. Sushi domains also known as Complement control protein (CCP) modules, or short consensus repeats (SCR), exist in a wide variety of complement and adhesion proteins. The structure is known for this domain, it is based on a beta-sandwich arrangement; one face made up of three beta-strands hydrogen-bonded to form a triple-stranded region at its centre and the other face formed from two separate beta-strands. SELP additionally has a transmembrane domain in the 773-795 region. Transmembrane domains are composed of 15-30 hydrophobic residues and are found in proteins that span a membrane in a cell. A protein can have a single TM domain (e.g. Type I transmembrane receptors such as EGF receptor) or multiple TM domains (e.g. G-protein coupled receptors). To span the hydrocarbon core of the membrane of ~3 nm requires an alpha helix of ~20 uncharged predominantly apolar residues. Membrane separates two aqueous compartments by a thin two dimensional lipid phase. Membrane proteins generally span this lipid phase and therefore needed to accomodate to the hydrophilic stretch on both sides of the membrane as well as to the hydrophobic environment in the core of the bilayer. The structure of the membrane embedded portions consist of either of transmembrane alpha helices often assembled in to helix bundles or of antiparralel beta sheets forming barrel shaped pores. The length of the transmembrane helix may even correlate with the thickness of its membrane. Single spanning membrane proteins of the Endoplasmic reticulum (ER) and Golgi generally have shorter transmembrane domains than plasma membrane proteins. Since cholestrol content and thus the thickness of the lipid bilayer also increases along with the secretory pathway, this might reflect a role of the transmembrane segments and proteins in lipid sorting. In multi spanning membrane proteins the transmembrane helices are tightly bundled to compact, globular structure from which lipids are excluded. The protein has high homology (>69%) to the protein sequences of SELP described for mouse and rat. This protein is located mainly in the plasma membrane. Expression analysis in different tissues demonstrated medium level expression in almost all tissues analyzed. SELP is a 140-kD adhesion molecule, expressed at the surface of activated cells, that mediates the interaction of activated endothelial cells or platelets with leukocytes. SELP was detected in megakaryocytes and platelets, as well as in vascular endothelial cells, but was not found in a variety of other cell types examined. In endothelial cells, the protein was localized to the membranes of Weibel-Palade bodies, the intracellular storage granules for von Willebrand factor. CD24 is a ligand for P-selectin. Florian et al. (Florian et al., Biochem. Biophys. Res. Commun.; 281: 1045-1050 (2001)) demonstrated that sorting nexin-17 (SNX17) interacts with the cytosolic domain of P-selectin and suggested that SNX17 may function in the intracellular trafficking of P-selectin. Mayadas et al. (Mayadas et al., Cell; 74: 541-554 (1993)) generated P-selectin-deficient mice by gene targeting in embryonic stem cells and found that they exhibited a number of defects in leukocyte behavior, including elevated numbers of circulating neutrophils, virtually total absence of leukocyte rolling in mesenteric venules, and delayed recruitment of neutrophils to the peritoneal cavity upon experimentally induced inflammation.

Suitable MHC ligands/fragments of human SELP can be identified by the method described in connection with the Cologne 1 above.

SEMA3G:

Human SEMA3G (sema domain, immunoglobulin domain (Ig), short basic domain, secreted, (semaphorin) 3G) is located in the 52454082-52442307 genomic region on chromosome 3 in the 3p21.1 region. It consists of 16 exons resulting after transcription in an mRNA which has 4700 base pairs (see SEQ ID NO:93). The actual coding sequence itself consists of 2349 base pairs. The translation of this sequence results in a putative protein with a length of 782 amino acids (SEQ ID NO:94).

The protein was screened for functional domains and SEMA3G has a semaphorin domain in the 58-503 region, which occur in semaphorins, a large family of secreted and transmembrane proteins, some of which function as repellent signals during axon guidance. Sema domains also occur in a hepatocyte growth factor receptor, in SEX protein and in viral proteins. The Sema domain is characterised by a conserved set of cysteine residues, which form four disulfide bonds to stabilise the structure. The Sema domain fold is a variation of the beta propeller topology, with seven blades radially arranged around a central axis. Each blade contains a four-stranded (strands A to D) antiparallel beta sheet. The inner strand of each blade (A) lines the channel at the center of the propeller, with strands B and C of the same repeat radiating outward, and strand D of the next repeat forming the outer edge of the blade. The large size of the Sema domain is not due to a single inserted domain but results from the presence of additional secondary structure elements inserted in most of the blades. The Sema domain uses a 'loop and hook' system to close the circle between the first and the last blades. The blades are constructed sequentially with an N-terminal beta-strand closing the circle by providing the outermost strand (D) of the seventh (C-terminal) blade. The beta-propeller is further stabilized by an extension of the N-terminus, providing an additional, fifth beta-strand on the outer edge of blade 6. SEMA3G additionally has a PSI domain in the 521-574 region, which has been found in plexins, semaphorins and integrins. Semaphorins induce the collapse and paralysis of neuronal growth cones. In addition, SEMA3G has an immunoglobulin-like domain in the 588-674 region. Ig molecules are highly modular proteins, in which the variable and constant domains have clear, conserved sequence patterns. The domains in Ig and Ig-like molecules are grouped into four types: V-set (variable), C1-set (constant-1), C2-set (constant-2) and I-set (intermediate). Structural studies have shown that these domains share a common core Greek-key beta-sandwich structure, with the types differing in the number of strands in the beta-sheets as well as in their sequence patterns. Immunoglobulin-like domains that are related in both sequence and structure can be found in several diverse protein families. Ig-like domains are involved in a variety of functions, including cell-cell recognition, cell-surface receptors, muscle structure and the immune system. Furthermore, SEMA3G has an N-terminal signal peptide domain in the 1-23 region. It is usually located at the N terminus and normally absent from the mature protein. Normally refers to the sequence (ca. 20 amino acids) that interacts with signal recognition particle and directs the ribosome to the endoplasmic reticulum where co translational insertion takes place. Signal peptides are highly hydrophobic but with some positively charged residues. The signal sequence is normally removed from the growing peptide chain by signal peptidase, a specific protease located on the cisternal face of the endoplasmic reticulum. Transmembrane domain prediction with an online transmembrane domain prediction server "DAS" identified 8 potential transmembrane regions (7-18, 74-78, 145-145, 326-344, 461-469, 584-591, 665-678, 713-715) whereas the 3 regions from 8-17, 328-341, and 666-677 had the highest probability. The protein has high homology (>86%) to the protein sequences of SEMA3G described for mouse and rat. This protein is an integral membrane protein. Expression analysis in different tissues demonstrated medium level expression in heart, spleen, and lung tissue while only low levels or absent expression of SEMA3G was observed in all other tissues analyzed, including bone marrow, liver, kidney, thymus, skeletal muscle, brain, spinal cord, prostate, and pancreas. Suitable MHC ligands/fragments of human SEMA3G can be identified by the method described in connection with the Cologne 1 above.

SHMT2:

Human SHMT2 (serine hydroxymethyltransferase 2 (mitochondrial)) is located in the 55909818-55914980 genomic region on chromosome 12 in the 12q12-q14 region. It consists of 12 exons resulting after transcription in an mRNA which has 2113 base pairs (see SEQ ID NO:95). The actual coding sequence itself consists of 1515 base pairs. The translation of this sequence results in a putative protein with a length of 504 amino acids (SEQ ID NO:96).

The protein was screened for functional domains and SHMT2 has a serine hydroxymethyltransferase domain in the 49-448 region. Transmembrane domain prediction with an online transmembrane domain prediction server "DAS" identified 2 potential transmembrane regions (255-261, 333-338). The protein has high homology (>94%) to the protein sequences of SHMT2 described for mouse and rat. This protein is located mainly in the nucleus and mitochondria.

Expression analysis in different tissues demonstrated medium level expression in almost all tissues analyzed, including liver, heart, spleen, kidney, thymus, skeletal muscle, spinal cord, prostate, and pancreas.

Suitable MHC ligands/fragments of human SHMT2 can be identified by the method described in connection with the Cologne 1 above.

STAM:

Human STAM (signal transducing adaptor molecule (SH3 domain and ITAM motif) 1) is located in the 17726129-17797912 genomic region on chromosome 10 in the 10p14-p13 region. It consists of 13 exons resulting after transcription in an mRNA which has 2967 base pairs (see SEQ ID NO:97). The actual coding sequence itself consists of 1623 base pairs. The translation of this sequence results in a putative protein with a length of 540 amino acids (SEQ ID NO:98).

STAM was identified by the rapid tyrosine-phosphorylation of its product in response to cytokine stimulation. The encoded protein contains a SH3 domain and the immunoreceptor tyrosine-based activation motif (ITAM). This protein associates with JAK3 and JAK2 kinases via its ITAM region, and is phosphorylated by the JAK kinases upon cytokine stimulation, which suggests the function of this protein is as an adaptor molecule involved in the downstream signaling of cytokine receptors. HGS/HRS (hepatocyte growth factor-regulated tyrosine kinase substrate) has been found to bind and counteract the function of this protein. The protein was screened for functional domains and STAM has a VHS domain in the 9-139 region. The VHS domain is a ~140 residues long domain, whose name is derived from its occurrence in VPS-27, Hrs and STAM. The VHS domain is always found at the N-terminus of proteins suggesting that such topology is important for function. The domain is considered to have a general membrane targeting/cargo recognition role in vesicular trafficking. Resolution of the crystal structure of the VHS domain of Drosophila Hrs and human Tom1 revealed that it consists of eight helices arranged in a double-layer superhelix. The existence of conserved patches of residues on the domain surface suggests that VHS domains may be involved in protein-protein recognition and docking. Overall, sequence similarity is low (approx 25%) amongst domain family members. STAM additionally has an ubiquitin interacting motif (UIM) domain in the 171-190 region, which was first described in the 26S proteasome subunit PSD4/RPN-10. It is known to bind multiple ubiquitin and was also found in many proteins involved in the endocytic pathway. In addition, STAM has a Src homology 3 (SH3) domain in the 213-268 region, which binds to target proteins through sequences containing proline and hydrophobic amino acids. Pro-containing polypeptides may bind to SH3 domains in 2 different binding orientations. SH3 (src Homology-3) domains are small protein modules containing approximately 50 amino acid residues. They are found in a great variety of intracellular or membrane-associated proteins for example, in a variety of proteins with enzymatic activity, in adaptor proteins that lack catalytic sequences and in cytoskeletal proteins. The SH3 domain has a characteristic fold which consists of five or six beta-strands arranged as two tightly packed anti-parallel beta sheets. The linker regions may contain short helices. The surface of the SH2-domain bears a flat, hydrophobic ligand-binding pocket which consists of three shallow grooves defined by conservative aromatic residues in which the ligand adopts an extended left-handed helical arrangement. The ligand binds with low affinity but this may be enhanced by multiple interactions. The region bound by the SH3 domain is in all cases proline-rich and contains PXXP as a core-conserved binding motif. The function of the SH3 domain is not well understood but they may mediate many diverse processes such as increasing local concentration of proteins, altering their subcellular location and mediating the assembly of large multiprotein complexes. STAM also has an immunoreceptor tyrosine-based activation motif domain in the 359-387 region, which is a motif that may be dually phosphorylated on tyrosine and that links antigen receptors to downstream signalling machinery. Phosphorylated immunoreceptor signaling motifs (ITAMs) exhibit unique abilities to bind and activate Lyn and Syk tyrosine kinases. Motif may be dually phosphorylated on tyrosine that links antigen receptors to downstream signalling machinery. Furthermore, STAM additionally has a Coiled Coil domain in the 343-377 region. Coiled coil is a protein domain that forms a bundle of two or three alpha helices. Short coiled coil domains are involved in protein interactions but long coiled coil domains which from long rods occur in structural or motor proteins. Transmembrane domain prediction with an online transmembrane domain prediction server "DAS" identified 1 potential transmembrane region (64-74) whereas the region from 66-71 had the highest probability. The protein has high homology (>91%) to the protein sequences of STAM described for mouse and rat. This protein is located mainly in the cytoplasm. Expression analysis in different tissues demonstrated medium level expression in almost all tissues analyzed. Takeshita et al. (Takeshita et al., Biochem. Biophys. Res. Commun.; 225: 1035-1039 (1996)) suggested that STAM acts as an adaptor molecule in signal transduction pathways from cytokine receptors. Asao et al. (Asao et al., J. Biol. Chem.; 272: 32785-32791 (1997)) showed that HGS binds to STAM via coiled-coil sequences and appears to regulate proliferation in response to cytokines.

Suitable MHC ligands/fragments of human STAM can be identified by the method described in connection with the Cologne 1 above.

STOM:

Human STOM (stomatin), is located in the 123172365-123141173 genomic region on chromosome 9 in the 9q34.1 region. STOM isoform 1 consists of 7 exons resulting after transcription in an mRNA which has 3108 base pairs (see SEQ ID NO:99). The actual coding sequence itself consists of 867 base pairs. The translation of this sequence results in a putative protein with a length of 288 amino acids (SEQ ID NO:100). STOM isoform 2 consists of 3 exons resulting after transcription in an mRNA which has 2593 base pairs (see SEQ ID NO:101). The actual coding sequence itself consists of 372 base pairs. The translation of this sequence results in a putative protein with a length of 123 amino acids (SEQ ID NO:102).

The protein was screened for functional domains and STOM isoform 1 has a prohibitin homologues (PHB) domain in the 52-211 region, which is an integral membrane protein domain which is thought to regulate cation conductance. A variety of proteins belong to this family. These include the prohibitins, cytoplasmic anti-proliferative proteins and stomatin, an erythrocyte membrane protein. Bacterial HflC protein also belongs to this family. STOM isoform 2 has a transmembrane domain in the 32-54 region. Transmembrane domains are composed of 15-30 hydrophobic residues and are found in proteins that span a membrane in a cell. A protein can have a single TM domain (e.g. Type I transmembrane receptors such as EGF receptor) or multiple TM domains (e.g. G-protein coupled receptors). To span the hydrocarbon core of the membrane of ~3 nm requires an alpha helix of ~20 uncharged predominantly apolar residues. Membrane separates two aqueous compartments by a thin two dimensional lipid phase. Membrane proteins generally span this lipid phase and therefore needed to accomodate to the hydrophilic stretch on both sides of the membrane as well as to the hydrophobic environment in the core of the bilayer. The structure of the membrane embedded portions consist of either of transmembrane alpha helices often assembled in to helix bundles or of antiparralel beta sheets forming barrel shaped pores. The length of the transmembrane helix may even correlate with the thickness of its membrane. Single spanning membrane proteins of the Endoplasmic reticulum (ER) and Golgi generally have shorter transmembrane domains than plasma membrane proteins. Since cholestrol content and thus the thickness of the lipid bilayer also increases along with the secretory pathway, this might reflect a role of the transmembrane segments and proteins in lipid sorting. In multi spanning membrane proteins the transmembrane helices are tightly bundled to compact, globular structure from which lipids are excluded. The putative protein has high homology (>87%) to the putative protein sequences of STOM described for mouse and rat. STOM is a 29,000-kD integral membrane protein that is exposed on the cytoplasmic surface of the membrane and is susceptible to phosphorylation by a cAMP-dependent protein kinase. The same protein can be demonstrated in human cell lines of epithelial and lymphoid origin, notably in HeLa cells. Structural analysis assigned STOM to the type Ib transmembrane proteins. STOM has a wide pattern of expression, with high levels of mRNA in heart, liver, skeletal muscle, and testis but low levels in lung, brain, and spleen. Models of the predicted protein structure showed a short NH2-terminal head, a strongly hydrophobic 28-amino acid stretch presumably encoding a single membrane-spanning domain, and a large domain composed of beta sheet and alpha helix. Suitable MHC ligands/fragments of the human STOM proteins can be identified by the method described in connection with the Cologne 1 above.

TCF7:

Human TCF7 (transcription factor 7 (T-cell specific, HMG-box)), is located in the 133478300-133511818 genomic region on chromosome 5 in the 5q31.1 region. TCF 7 isoform 1 consists of 9 exons resulting after transcription in an mRNA which has 3283 base pairs (see SEQ ID NO:107). The actual coding sequence itself consists of 1155 base pairs. The translation of this sequence results in a putative protein with a length of 384 amino acids (SEQ ID NO:108). TCF 7 isoform 2 consists of 7 exons resulting after transcription in an mRNA which has 2821 base pairs (see SEQ ID NO:109). The actual coding sequence itself consists of 810 base pairs. The translation of this sequence results in a putative protein with a length of 269 amino acids (SEQ ID NO:110). TCF 7 isoform 3 consists of 7 exons resulting after transcription in an mRNA which has 1254 base pairs (see SEQ ID NO:111). The actual coding sequence itself consists of 810 base pairs. The translation of this sequence results in a putative protein with a length of 269 amino acids (SEQ ID NO:112). TCF 7 isoform 4 consists of 8 exons resulting after transcription in an mRNA which has 2917 base pairs (see SEQ ID NO:113). The actual coding sequence itself consists of 807 base pairs. The translation of this sequence results in a putative protein with a length of 268 amino acids (SEQ ID NO:114).

The protein was screened for functional domains and TCF7 has a high mobility group (HMG) domain in the 268-338 region. HMG proteins are a family of relatively low molecular weight non-histone components in chromatin. HMG1 (also called HMG-T in fish) and HMG2 are two highly related proteins that bind single-stranded DNA preferentially and unwind double-stranded DNA. Although they have no sequence specificity, they have a high affinity for bent or distorted DNA, and bend linear DNA. HMG1 and HMG2 contain two DNA-binding HMG-box domains (A and B) that show structural and functional differences, and have a long acidic C-terminal domain rich in aspartic and glutamic acid residues. The acidic tail modulates the affinity of the tandem HMG boxes in HMG1 and 2 for a variety of DNA targets. HMG1 and 2 appear to play important architectural roles in the assembly of nucleoprotein complexes in a variety of biological processes, for example V(D)J recombination, the initiation of transcription, and DNA repair. Transmembrane domain prediction with an online transmembrane domain prediction server "DAS" identified 1 potential transmembrane regions (217-233), 3 potential transmembrane regions (11-13, 82-84, 100-109), 3 potential transmembrane regions (10-13, 80-85, 98-109), respectively 3 potential transmembrane regions (11-13, 82-84, 99-109). The putative protein has high homology (>93%) to the putative protein sequences of TCF7 described for mouse and rat. This protein is located mainly in the nucleus. Expression analysis in different tissues demonstrated medium level expression in almost all tissues analyzed. CD3E gene expression appears to be controlled by a downstream T lymphocyte-specific enhancer element. Van de Wetering et al. (van de Wetering et al., J. Biol. Chem.; 267: 8530-8536 (1992)) identified a T cell-specific transcription factor, which they called TCF1/TCF7, that showed binding to this element. Kingsmore et al. (Kingsmore et al., Mamm. Genome; 6: 378 (1995)) mapped the homologous gene to mouse chromosome 11. Van de Wetering et al. (van de Wetering et al., Embo J.; 10: 123-132 (1991)) mapped the gene to 5q31.1 by a combination of study of somatic cell hybrids and fluorescence in situ hybridization. Although the literature continues to use the symbol TCF1 for this gene, TCF7 is its official designation. Verbeek et al. (Verbeek et al., Nature; 374: 70-74 (1995)) generated 2 independent germline mutations in TCF7 by targeted disruption and found that thymocyte development in otherwise normal mutant mice is blocked at the transition from the CD8+ immature single-positive to the CD4+/CD8+ double-positive stage. In contrast to wildtype mice, most of the immature single-positive cells in the mutants are not in the cell cycle and the number of immunocompetent T cells in the peripheral lymphoid organs is reduced. Verbeek et al. (Verbeek et al., Nature; 374: 70-74 (1995)) concluded that TCF7 controls an essential step in thymocyte differentiation. Roose et al. (Roose et al., Science; 285: 1923-1926 (1999)) demonstrated that one of the target genes of TCF4, or TCF7L2, in epithelial cells is TCF7. The most abundant TCF7 isoforms lack a beta-catenin interaction domain. TCF7−/− mice develop adenomas in the gut and mammary glands. Introduction of a mutant APC allele into these mice substantially increases the number of these adenomas. TCF7 may act as a feedback repressor of beta-catenin TCF4 (TCF7L2) target genes and thus may cooperate with APC to suppress malignant transformation of epithelial cells. Roose et al. (Roose et al., Science; 285: 1923-1926 (1999)) detected nuclear TCF7 protein in normal human tissues, in proliferating intestinal epithelial cells, and in the basal epithelial cells of mammary gland epithelium. Roose et al. (Roose et al., Science; 285: 1923-1926 (1999)) hypothesized that one possible explanation for the tumor phenotype in TCF7−/− mice is that TCF7 acts as a feedback transcriptional repressor of the beta-catenin in TCF4 target genes, and that disruption of this negative feedback loop allows the formation of epithelial tumors much like the loss of APC. This notion predicts synergy between the loss of TCF7 and of APC. Roose et al. (Roose et al., Science; 285: 1923-1926 (1999)) proposed a model in which the transcriptional activation of target genes such as c-myc and cyclin D1 by beta-catenin/TCF4 is counteracted by repressor isoforms of TCF7.

Suitable MHC ligands/fragments of the human TCF7 proteins can be identified by the method described in connection with the Cologne 1 above.

TNFRSF1B:

Human TNFRSF1B (tumor necrosis factor receptor superfamily, member 1B), also known as CD120b or TNF-R-II, is located in the 12149646-12191863 genomic region on chromosome 1 in the 1p36.3-p36.2 region. It consists of 10 exons resulting after transcription in an mRNA which has 3682 base pairs (see SEQ ID NO:115). The actual coding sequence itself consists of 1386 base pairs. The translation of this sequence results in a putative protein with a length of 461 amino acids (SEQ ID NO:116).

TNFRSF1B is a member of the TNF-receptor superfamily. This protein and TNF-receptor 1 form a heterocomplex that mediates the recruitment of two anti-apoptotic proteins, c-IAP1 and c-IAP2, which possess E3 ubiquitin ligase activity. The function of IAPs in TNF-receptor signalling is unknown, however, c-IAP1 is thought to potentiate TNF-induced apoptosis by the ubiquitination and degradation of TNF-receptor-associated factor 2, which mediates anti-apoptotic signals. Knockout studies in mice also suggest a role of this protein in protecting neurons from apoptosis by stimulating antioxidative pathways.

The protein was screened for functional domains and TNFRSF1B has 4 tumor necrosis factor receptor/nerve growth factor receptor repeat domains in the 40-75, 78-118, 120-161, and 164-200 regions. TNFSF1B additionally has a transmembrane domain in the 258-280 region. Transmembrane domains are composed of 15-30 hydrophobic residues and are found in proteins that span a membrane in a cell. A protein can have a single TM domain (e.g. Type I transmembrane receptors such as EGF receptor) or multiple TM domains (e.g. G-protein coupled receptors). To span the hydrocarbon core of the membrane of ~3 nm requires an alpha helix of ~20 uncharged predominantly apolar residues. Membrane separates two aqueous compartments by a thin two dimensional lipid phase. Membrane proteins generally span this lipid phase and therefore needed to accomodate to the hydrophilic stretch on both sides of the membrane as well as to the hydrophobic environment in the core of the bilayer. The structure of the membrane embedded portions consist of either of transmembrane alpha helices often assembled in to helix bundles or of antiparralel beta sheets forming barrel shaped pores. The length of the transmembrane helix may even correlate with the thickness of its membrane. Single spanning membrane proteins of the Endoplasmic reticulum (ER) and Golgi generally have shorter transmembrane domains than plasma membrane proteins. Since cholestrol content and thus the thickness of the lipid bilayer also increases along with the secretory pathway, this might reflect a role of the transmembrane segments and proteins in lipid sorting. In multi spanning membrane proteins the transmembrane helices are tightly bundled to compact, globular structure from which lipids are excluded. In addition, TNFRSF1B has an N-terminal signal peptide domain in the 1-23 region. It is usually located at the N terminus and normally absent from the mature protein. Normally refers to the sequence (ca. 20 amino acids) that interacts with signal recognition particle and directs the ribosome to the endoplasmic reticulum where co translational insertion takes place. Signal peptides are highly hydrophobic but with some positively charged residues. The signal sequence is normally removed from the growing peptide chain by signal peptidase, a specific protease located on the cisternal face of the endoplasmic reticulum. The protein has modest homology (>60%) to the putative protein sequences of TNFRSF1B described for mouse and rat. This protein is located mainly in the cell membrane. TNFRSF1B is present on many cell types, especially those of myeloid origin, and is strongly expressed on stimulated T and B lymphocytes. Beltinger et al. (Beltinger et al., Genomics; 35: 94-100 (1996)) noted that TNFR2 is the main TNF receptor found on circulating T cells and is the major mediator of autoregulatory apoptosis in CD8+ cells. TNFR2 may act with TNFR1 to kill nonlymphoid cells. Preassembly or self-association of cytokine receptor dimers occurs via the same amino acid contacts that are critical for ligand binding. Chan et al. (Chan et al., Science; 288: 2351-2354 (2000)) found that, in contrast, the p60 (TNFRSF1A;) and p80 (TNFRSF1B) TNFA receptors self-assemble through a distinct functional domain in the TNFR extracellular domain, termed the pre-ligand assembly domain (PLAD), in the absence of ligand. Deletion of the PLAD results in monomeric presentation of p60 or p80. Flow cytometric analysis showed that efficient TNFA binding depends on receptor self-assembly. They also found that other members of the TNF receptor superfamily, including the extracellular domains of TRAIL, CD40, and FAS, all self-associate but do not interact with heterologous receptors. Using Jurkat T cells, which express TNFR1 but little TNFR2, and Jurkat cells stably transfected with TNFR2, Li et al. (Li et al., Nature; 416: 345-347 (2002)) confirmed that TNF stimulation, or stimulation with a TNFR2, but not TNFR1, agonist, causes a loss of TRAF2 in the TNFR2-expressing cells, but not the parental cell line, through a ubiquitination- and proteasome-dependent process. Binding analysis indicated that TRAF2 interacts with CIAP1 and CIAP2, which possess E3 ubiquitin ligase activity. Ubiquitination assays and SDS-PAGE analysis showed that in the presence of an E2-conjugating enzyme CIAP1, but not CIAP2, induces TRAF2 ubiquitination outside of its RING domain. Both CIAPs bind but neither ubiquitinates TRAF1. CIAP1 expression fails to protect TNFR2-expressing cells from TNF-induced apoptosis, whereas an E3-inactive CIAP1 mutant and wildtype CIAP2 do protect cells from TRAF2 downregulation and cause a delay in cell death. Li et al. (Li et al., Nature; 416: 345-347 (2002)) concluded that TNFR2 stimulation causes the ubiquitination of TRAF2 by CIAP1, which can play a proapoptotic role in TNF signaling.

Suitable MHC ligands/fragments of human TNFRSF1B can be identified by the method described in connection with the Cologne 1 above.

TRIM16:

Human TRIM16 (tripartite motif-containing 16), also known as estrogen-responsive B box protein, is located in the 15526917-15472004 genomic region on chromosome 17 in the 17p11.2 region. It consists of 9 exons resulting after transcription in an mRNA which has 2920 base pairs (see SEQ ID NO:117). The actual coding sequence itself consists of 1695 base pairs. The translation of this sequence results in a putative protein with a length of 564 amino acids (SEQ ID NO:118).

This gene was identified as an estrogen and anti-estrogen regulated gene in epithelial cells stably expressing estrogen receptor. The protein encoded by this gene contains two B box domains and a coiled-coiled region that are characteristic of the B box zinc finger protein family. The proteins of this family have been reported to be involved in a variety of biological processes including cell growth, differentiation and pathogenesis. Expression of this gene was detected in most tissues. Its function, however, has not yet been determined.

The protein was screened for functional domains and TRIM16 has a B-box zinc finger domain in the 126-651 region. The B-box zinc finger is an around 40 amino acids domain. One or two copies of this motif are generally associated with a ring finger and a coiled coil motif to form the so-called tripartite motif. It is found essentially in transcription factors, ribonucleoproteins and protooncoproteins, but no function is clearly assigned to this domain. It has been shown to be essential but not sufficient to localize the PML protein in a punctate pattern in interphase nuclei. Among the 7 possible ligands for the zinc atom contained in a B-box, only 4 are used and bind one zinc atom in a Cys2-His2 tetrahedral arrangement. The NMR analysis reveals that the B-box structure comprises two beta-strands, two helical turns and three extended loop regions different from any other zinc binding motif. TRIM16 additionally has a PRY domain in the 372-425 region. PRY is a domain associated with SPRY domains. The SPRY domain is of unknown function however distant homologues are domains in butyrophilin/marenostrin/pyrin. Ca2+-release from the sarcoplasmic or endoplasmic reticulum, the intracellular Ca2+ store, is mediated by the ryanodine receptor (RyR) and/or the inositol trisphosphate receptor (IP3R). It contains a RING-finger domain N-terminal to the PRY domain. The RING-finger is a specialized type of Zn-finger of 40 to 60 residues that binds two atoms of zinc, and is probably involved in mediating protein-protein interactions. There are two different variants, the C3HC4-type and a C3H2C3-type, which is clearly related despite the different cysteine/histidine pattern. This set of proteins are described as TRIM (TRIpartite Motif) family members and are involved in cellular compartmentalisation. The TRIM family sequences are defined by a Ring finger domain, a B-box type1 (B1) and a B-box type 2 (B2) followed by a coiled-coil (CC) region. Genes belonging to this family are implicated in a variety of processes such as development and cell growth and are involved in human disease. Many of these proteins, if not all of those with the PRY domain have a number of C-terminal signatures, SPRY, RFP-like (B30.2) and butyrophilin domain. The B30.2-like domain is a well conserved C-terminal domain of 160-170 amino acids which is found in nuclear and cytoplasmic proteins, as well as transmembrane and secreted proteins. The function of the B30.2-like domain is not known, but the cytoplasmic B30.2-like domain of butyrophilin has been shown to interact with xanthine oxidase. TRIM16 additionally has a SPRY domain in the 426-551 region. The SPRY domain is of unknown function. Distant homologues are domains in butyrophilin/marenostrin/pyrin. $Ca^{2+}$-release from the sarcoplasmic or endoplasmic reticulum, the intracellular $Ca^{2+}$ store, is mediated by the ryanodine receptor (RyR) and/or the inositol trisphosphate receptor (IP3R). Furthermore, TRIM16 additionally has 3 Coiled Coil domains in the 166-203, 251-271, and 320-340 region. Coiled coil is a protein domain that forms a bundle of two or three alpha helices. short coiled coil domains are involved in protein interactions but long coiled coil domains which from long rods occur in structural or motor proteins. Transmembrane domain prediction with an online transmembrane domain prediction server "DAS" identified 2 potential transmembrane regions (440-442, 501-507). The putative protein has high homology (>75%) to the putative protein sequences of TRIM16 described for mouse and rat. This protein is located mainly in the cytoplasm. Expression analysis of TRIM16 in different tissues demonstrated medium level expression in almost all tissues analyzed. Liu et al. (Liu et al., Mol. Endocrinol.; 12: 1733-1748 (1998)) found that estrogen treatment of an ER-expressing human mammary epithelial cell line increased TRIM16 mRNA steady-state levels 3-fold. They showed that the estrogen-dependent increase in TRIM16 mRNA was an early event that did not require new protein synthesis. Beer et al. (Beer et al., J. Biol. Chem.; 277: 20740-20749 (2002)) found that KGF stimulation of quiescent human keratinocytes caused a biphasic expression of TRIM16 mRNA. After a minor initial increase at 1 hour following stimulation, mRNA levels declined strongly within 5 to 8 hours. TRIM16 expression was downregulated in the thickened epithelium of mouse skin wounds. Overexpression of TRIM16 in keratinocytes did not affect their proliferation rate, but enhanced the early differentiation process and increased the expression of genes associated with keratinocyte differentiation.

Suitable MHC ligands/fragments of human TRIM16 can be identified by the method described in connection with the Cologne 1 above.

UTS2:

Human UTS2 (urotensin 2), is located in the 7836158-7830261 genomic region on chromosome 1 in the 1p36 region. Two transcript variants encoding different preproprotein isoforms have been described for this gene. Isoform a consists of 5 exons resulting after transcription in an mRNA which has 558 base pairs (see SEQ ID NO:119). The actual coding sequence itself consists of 420 base pairs. The translation of this sequence results in a preproprotein with a length of 139 amino acids (SEQ ID NO:120). Isoform b consists of 4 exons resulting after transcription in an mRNA which has 652 base pairs (see SEQ ID NO:121). The actual coding sequence itself consists of 375 base pairs. The translation of this sequence results in a preproprotein with a length of 124 amino acids (SEQ ID NO:122).

This gene encodes a mature peptide that is an active cyclic heptapeptide absolutely conserved from lamprey to human. The active peptide acts as a vasoconstrictor and is expressed only in brain tissue. Despite the gene family name similarity, this gene is not homologous to urocortin, a member of the sauvagine/corticotropin-releasing factor/urotensin I family. Most of the proprotein is cleaved to make the mature peptide.

The protein was screened for functional domains and UTS2 has an N-terminal signal peptide domain in the 1-18 respectively 1-21 region. It is usually located at the N terminus and normally absent from the mature protein. Normally refers to the sequence (ca. 20 amino acids) that interacts with signal recognition particle and directs the ribosome to the endoplasmic reticulum where co translational insertion takes place. Signal peptides are highly hydrophobic but with some positively charged residues. The signal sequence is normally removed from the growing peptide chain by signal peptidase, a specific protease located on the cisternal face of the endoplasmic reticulum. Transmembrane domain prediction with an online transmembrane domain prediction server "DAS" identified for isoform a 3 potential transmembrane regions (8-13, 35-44, 113-119) whereas the region from 40-41 has the highest probability and for isoform b 2 potential transmembrane regions (6-22, 98-103) whereas the region from 8-19 has the highest probability. The putative proteins have modest homology (~50%) to the protein sequences of UTS2 described for mouse and rat. This protein is located mainly in the plasmamembrane or secreted. Expression analysis in different tissues demonstrated medium level expression in bone marrow, spleen, and cranial nerve tissue as well as heart tissue and blood vessels while only low levels or absent expression of UTS2 was observed in all other tissues analyzed.

UTS2 is a cyclic 12-amino acid peptide that has some sequence similarity, but is not homologous, to somatostatin-14. The characterization of UTS2 from the urophysis of various teleost species has shown that the structure of the C-terminal cyclic hexapeptide has been fully conserved, while several substitutions have occurred in the N-terminal region of the molecule. Subsequently it was found that UTS2-like molecules are present in distant taxa, from mollusks to amphibians, suggesting that urotensin-related peptides may also occur in mammals. In addition, specific binding sites for UTS2 were demonstrated in rat blood vessels, and fish UTS2 was found to exert cardiovascular effects in rat and rabbit. It was also found that the mouse anococcygeus muscle has special sensitivity to UTS2. Coulouarn et al. (Coulouarn et al., Proc. Natl. Acad. Sci. USA; 95: 15803-15808 (1998)) clearly established the existence of UTS2 in mammals by characterizing cDNAs encoding the UTS2 precursors. The UTS2 sequence is located at the C-terminal position of the precursor. Human UTS2 is composed of only 11 amino acid residues. The cyclic region of UTS2, which is responsible for the biologic activity of the peptide, has been fully conserved from fish to human. Northern blot and dot blot analysis showed that UTS2 precursor mRNAs are found predominantly in the human spinal cord. Ames et al. (Ames et al., Nature; 401: 282-286 (1999)) identified a human G protein-coupled receptor, GPR14 which functions as a UTS2 receptor. Human UTS2 binds to recombinant human GPR14 with high affinity, and the binding is functionally coupled to calcium mobilization. Human UTS2 is found within both vascular and cardiac tissue, including coronary atheroma, and effectively constricts isolated arteries from nonhuman primates. The potency of vasoconstriction of UTS2 was an order of magnitude greater than that of endothelin-1, making human UTS2 the most potent mammalian vasoconstrictor identified to that time. In vivo, human UTS2 markedly increased total peripheral resistance in anesthetized nonhuman primates, a response associated with profound cardiac contractile dysfunction. Furthermore, UTS2 immunoreactivity was found within the central nervous system and endocrine tissues, suggesting that it may have additional activities. UTS2 has several cardiovascular actions, including potent vasoactive, and cardiac inotropic and hypertropic properties. Douglas et al. (Douglas et al., Lancet; 359: 1990-1997 (2002)) investigated the degree of expression of UTS2 and its receptor GPR14 in the myocardium of patients with congestive heart failure. They obtained specimens of myocardium from the hearts of 19 patients with end-stage congestive heart failure, 5 patients with early-stage congestive heart failure, and 8 healthy controls. They found strong expression of UTS2 in the cardiomyocytes, and to a lesser extent in the vascular smooth muscle cells, endothelial cells, and inflammatory cells of patients with end-stage congestive heart failure. There was significantly less UTS2 expression in the myocardium of patients with early-stage congestive heart failure, and little or no UTS2 expression in the myocardium of healthy controls. RT-PCR showed increased concentrations of UTS2 and the presence of urotensin receptor mRNA in the myocardium of patients with congestive heart failure. Confocal microscopy showed a significant increase in the binding sites for UTS2 in the myocardium of patients with end-stage congestive heart failure.

Suitable MHC ligands/fragments of the human UTS2 can be identified by the method described in connection with the Cologne 1 above.

The muteins, derivatives and fragments of the proteins of aspects (1), (2) and (10) of the invention include (i) fragments having at least 8 amino acid residues, preferably at least 9 amino acid residues including peptide fragments that bind to major histocompatibility complex molecules;

(ii) derivatives including fusion proteins with at least one further functional proteinaceous domain and chemically modified proteins (e.g. PEGylated proteins) (wherein the type of the further proteinaceous domain and of the chemical modification depends on the intended utility of the protein)

(iii) muteins including sequences where up to 5, preferably up to 3 consecutive or separate amino acids residues have been deleted, substituted or added; and (iv) protein fragments having a sequence selected from SEQ ID NO:152-255, 256-435, 436-536, 537-660, 661-708 or 709-734.

In the following the invention is more closely explaned by reference to the proteins of aspect ((2) of the invention), namely the 6 proteins Colone 1 to Colone 6 and muteins, derivatives and fragments thereof, which shall, however, not be construed as a limitation of the invention. The genomic localisation, their DNA, RNA and protein structure of Cologne 1-6 as well as that of other genes coding for the proteins of the invention, as well as the protein domains have been explained hereinbefore. Additionaly, the putative function and the expression panel in other tissues has been shown hereinbefore.

In the experimental part a suitable cloning strategy is demonstrated by an expression of the 6 proteins in bacterial (*E. coli*) as well as mammalian cells (Jurkat cells, primary T cells). Full length cDNA clones were used to clone the cDNA of the 6 genes into the bacterial expression vector pTrcHis-TOPO (Invitrogen) and the two mammalian expression vectors pLenti6/V5-Dest and pCDNA6-His (Invitrogen). Further shown are methods for the generation of antibodies (monoclonal or polyclonal) antibodies against Cologne 1-6 or a peptide fragment of Cologne 1-6 and strategies for functional knock out of the 6 genes are described, which will enhance knowledge about the potential function and importance of the genes in $T_{reg}$ cells. Finally, shown are knock in strategies for the 6 genes into primary human conventional CD4⁺CD25⁻ T cells to determine the potential of the genes to induce $T_{reg}$ cell specific function and phenotype in non $T_{reg}$ cells are disclosed. In a preferred embodiment of aspects (1) and (2) of the invention the human T cells are isolatable from human peripheral blood, preferably by suitable monoclonal antibodies and using magnetic separation or immuno-adsorption methods. It is furthermore preferred that said human T cells are positive for FOXP3 and possess regulatory properties.

Aspect (3) of the invention pertains to a method for expressing the T cells of aspect (1) and (2) above. Said method may be effected ex vivo or in vivo. The T cell stimulating agent utilized in said method preferably is a composition comprising (a) anti-CD3 and/or anti-CD28 ligands/monoclonal antibodies, including super-agonistic antibodies, (b) a ligand/antibody to the T cell receptor on the surface of the cells of claim 1 or 2 or to T cell receptor components; or (c) MHC-peptide complexes binding to the T cell receptors expressed on the surface of the cells of claim 1 or 2; or (d) a phorbol ester and a calcium ionophor.

The expanded human T cells of aspect (4) of the invention as obtainable by the method of aspect (3) of the invention may be fixated. Such fixation can e.g. achieved by ex-vivo treatment with paraformaldehyde.

In the method for preparing the T cells of aspect (7) of the invention the defined antigens preferably are autoantigens (including, but not limited to, desmoglein 3 in the case of pemphigun *vulgaris*, melanA or tyrosinase in case of vitiligo; thyreoglobulin in case of thyreoiditis), foreign antigens (including pathogen-derived antigens such as hepatitis C), or alloantigens/transplantation antigens. The undefined antigens preferably are tissue or cell-derived antigens (including, but not limited to, but not limited to, antigens that are in the form of necrotic or apoptotic cells or tissue derived RNA or hybrids between cells of interest and dendritic cells/antigen presenting cells, other forms of delivery of undefined antigens into dendritic cells or other antigen presenting cells) or pathogen-derived antigens.

The pharmaceutical composition or medicament of aspects (9) and (16) of the invention, as well as the medicaments of aspects (20) and (23) of the invention may furthermore comprise pharmaceutically acceptable carriers known to a person skilled in the art. The pharmaceutical composition or medicament is preferably suitable for is suitable to treat diseases with enhanced immunity including, but not limited to, autoimmune diseases, graft versus host disease and graft rejections. The antibodies of aspect (15) of the invention or the antibody against the proteins of aspects (1), (2) and (10) of the invention, notably the antibodies against the proteins Cologne 1-6 can be prepared by methods well-established in the art including administration of (I) antigen presenting cell (APC) pulsed with a protein as defined in aspects (1), (2) and (10) or with Cologne 1-6, or a protein as defined in aspects (1), (2) and (10) or a peptide of Cologne 1-6 that activates B-cells to produce antibodies recognizing $T_{reg}$ cells in a protein specific (Cologne 1-6 specific) fashion, (II) a protein as defined in aspects (1), (2) and (10) or Cologne 1-6, or a peptide of a protein as defined in aspects (1), (2) and (10) or of Cologne 1-6 not necessarily in combination with an adjuvants, which is processed by an antigen presenting cell, which, in turn, activates B-cells to produce antibodies recognizing $T_{reg}$ cells in a protein specific (Cologne 1-6 specific) fashion, (III) a nucleic acid molecule encoding a protein as defined in aspects (1), (2) and (10) or Cologne 1-6, or a peptide of a protein as defined in aspects (1), (2) and (10) or of Cologne 1-6 not necessarily in an expression vector which is subsequently expressed so that it can be processed by an antigen presenting cell, which activates B-cells to produce antibodies recognizing the protein (Cologne 1-6) in a protein specific (Cologne 1-6 specific) fashion, or (IV) usage of a protein as defined in aspects (1), (2) and (10) or of Cologne 1-6, or a peptide of a protein as defined in aspects (1), (2) and (10) or of Cologne 1-6 to bind antibodies expressed by a phage library.

Numerous antibodies are expressed in the library as fusions with the coat protein of a bacteriophage, so that they are displayed on the surface of the viral particle. DNA extracted from interacting phages contain the sequences of the specific antibodies recognizing a protein as defined in aspects (1), (2) and (10) or of Cologne 1-6 in a protein specific (Cologne 1-6 specific) fashion.

Aspects (17) and (18) of the invention include the diagnostic detection of human CD4$^+$CD25$^+$FOXP3$^+$ $T_{reg}$ cells with antibodies specific for a protein of the invention, notably with Cologne 1-6 specific monoclonal or polyclonal antibodies (unlabeled or directly conjugated) in a protein specific (Cologne 1-6 specific) fashion by immunohistochemistry, immunofluorescence, flow cytometry, Western blot, immunoprecipitation, affinity chromatography and other techniques for the specific identification of protein expression. The antibody can be generated, for example, by immunization of mammalians, for example mouse, rat, goat, donkey, rabbit, with polypetides or peptides derived from the protein of the invention or from Cologne 1-6 with the addition of specific adjuvants or identified by phage display as specified above.

The aspects (17) and (18) of the invention also include the diagnostic detection of gene expression of the peptides of the invention or of Cologne 1-6 gene expression in human CD4$^+$CD25$^+$FOXP3$^+$ $T_{reg}$ cells with RT-PCR, Northern Blot, gene arrays and other techniques for the specific identification of gene expression, which may lead to a more specific identication of $T_{reg}$ cells Additionally, the peptides of the invention including the Cologne 1-6 genes may be differentially expressed in natural and adaptive CD4$^+$CD25$^+$FOXP3$^+$ $T_{reg}$ cells and therefore may help to discriminate these two distinct populations. If yes, these genes can be used as a lineage marker.

Furthermore this invention includes administering to the patient an antibody specific for a protein of the invention, notably a Cologne 1-6 specific monoclonal or polyclonal antibody (humanized, chimeric or non-humanized) that leads to death of (from here on said as kill) the cell in a Cologne 1-6 specific fashion. The antibody can be generated as outlined above.

The aspects (23) and (29) of the invention include administering to the patient cytotoxic T lymphocytes (CTL) (autologous or allogeneic) that elimate $T_{reg}$ cells in a protein specific (Cologne 1-6 specific), major histocompatibility complex-restricted fashion. The CTL can be generated, for example, by activation with antigen presenting cells that have been pulsed with the proteins of the invention or Cologne 1-6, or a peptide of the protein of the invention or of Cologne 1-6 that binds to a major histocompatibility complex molecule. The invention also includes an alternative method of treating a patient to eliminate $T_{reg}$ cells that express the protein of the invention (Cologne 1-6). This method involves administering to the patient an antigen presenting cell (APC) that activates in the patient a cytotoxic T lymphocyte that kills the cell in a protein specific (Cologne 1-6 specific), major histocompatibility complex-restricted fashion. The APC can be pulsed with the proteins of the invention or Cologne 1-6, or a peptide of the protein of the invention or of Cologne 1-6 that binds to a major histocompatibility complex molecule.

Another method included in the invention the method of eliminating $T_{reg}$ cells in a patient administering to the patient a protein of the invention or Cologne 1-6, or a peptide of the protein of the invention or of Cologne 1-6 that binds to a major histocompatibility complex molecule, which is processed by an antigen presenting cell in the patient, which, in turn, activates a cytotoxic T lymphocyte in the patient to induce cell death of the cell that expresses the protein of the invention (Cologne 1-6) in a protein specific (Cologne 1-6 specific), major histocompatibility complex-restricted fashion. The protein of the invention or Cologne 1-6 polypeptide or peptide of the protein of the invention or of Cologne 1-6 used in this method can be administered to the patient in association with an adjuvant. Aspects (25) and (30) of the invention pertain to a fourth method of specifically eliminating $T_{reg}$ cells that express the protein of the invention or Cologne 1-6. This method involves administering to the patient a nucleic acid molecule encoding the protein of the invention or Cologne 1-6, or a peptide of the protein of the invention or of Cologne 1-6 that binds to a major histocompatibility complex molecule. The nucleic acid molecule is expressed in the patient so that it can be processed by an antigen presenting cell in the patient, which activates a cytotoxic T lymphocyte in the patient to induce cell death of the cell that expresses the protein of the invention or Cologne 1-6, in a protein specific (Cologne 1-6 specific), major histocompatibility complex-restricted fashion. The nucleic acid molecule encoding the protein of the invention or Cologne 1-6, or a peptide of the protein of the invention or of Cologne 1-6 can be present in an expression vector.

Each of the methods described above can also include treatment based around a second (or more) $T_{reg}$ cell associated antigen or a peptide thereof that binds to MHC. In any of the methods described above, the patient can have $T_{reg}$ cells that express the protein of the invention or Cologne 1-6. APCs used in these methods can be, for example, a dendritic cell or a CD40-activated B cell. The peptide of the invention or Cologne 1-6 in these methods can bind to a class I or a class II major histocompatibility complex (MHC) molecule.

The invention also includes a method of assessing the level of immunity of a patient to the protein of the invention or Cologne 1-6, or a peptide of the protein of the invention or of Cologne 1-6 that binds to a major histocompatibility complex molecule. In this method, the level of cytotoxic T lymphocytes specific for the protein of the invention or for Cologne 1-6 or for a peptide of the protein of the invention or of Cologne 1-6 is measured in a sample from a patient. The sample can be obtained from the patient before, during, or after a treatment is administered to the patient. A sample can also be obtained, for example, before and after treatment.

The invention also includes peptides of the protein of the invention or Cologne 1-6 peptides (notably peptides of the proteins of aspect (10) of that bind to major histocompatibility complex molecules.

Aspects (2) and (22) of the invention include an ex vivo generated cytotoxic T lymphocyte that specifically kills a cell expressing the peptide of the invention or Cologne 1-6 in a specific, major histocompatibility complex-restricted fashion, and an ax vivo generated antigen presenting cell (e.g., a dendritic cell or a CD40-activated B cell) that presents a peptide of the peptide of the invention or of Cologne 1-6 in the context of a major histocompatibility complex molecule.

The pharmaceutical composition or medicament of aspect (9) of the invention which comprises the protein of the invention or Cologne 1-6 or a MHC-binding peptide thereof can be used for vaccination. These include, without limitation, the full length protein of the invention or full length Cologne 1-6 protein, MHC-binding fragments of the protein of the invention or of Cologne 1-6, as well as fusion proteins including the protein of the invention or Cologne 1-6 and MHC-binding fragments thereof. Peptides or polypeptides including the protein of the invention or Cologne 1-6 peptides and polypeptides can include 8, 9, 10, 11, 12, or more amino acid stretches having sequence identity with a region of the protein of the invention or of Cologne 1-6. For example, the peptides can include nine amino acid stretches, in which seven, eight, or all nine of the amino acids in the protein of the invention or of the Cologne 1-6 peptide nine amino acid sequence are identical to a region of nine amino acids in the protein of the invention or Cologne 1-6. In addition, a peptide or polypeptide out of the protein of the invention or a Cologne 1-6 peptide or polypeptide can include up to the full-length of amino acids that are identical to an amino acid sequence found in the protein of the invention or in Cologne 1-6, respectively, for example, 9-20, 20-40, 40-80, 80- to full-length, 80-200, or 200- to full-length amino acids that are identical to an amino acid sequence found in Cologne 1-6, respectively. Polypeptides containing the peptides of the protein of the invention or Cologne 1-6 peptides can contain additional amino acid stretches that do not correspond to the amino acid sequence of the protein of the invention or of Cologne 1-6, respectively.

To vaccinate to elicit an immune response specific to the protein of the invention or a Cologne 1-6 specific immune response in patients as well as animals, it is necessary to obtain large amounts of the peptide of the protein of the invention or of the Cologne 1-6 protein or peptide, and this can be accomplished by numerous standard methods, for example, chemical synthesis (e.g., Fmoc methods (Sigma Genosys); see above) or expression in eukaryotic or prokaryotic cells. Recombinant peptides of the protein of the invention or Cologne 1-6 peptides can be overexpressed in vivo by introducing coding sequences of the peptides into various types of cells, or in vitro, using cell-free expression systems that are shown in the art. The peptide products can then be purified for generating antibodies and CTLs specific for the proteins of the invention or Cologne 1-6 specific antibodies and CTLs (notably the antibodies of aspect (15) of the invention) ex vivo and for vaccine production.

According to aspects (17) and (18) of the invention, antibodies against the peptides of the protein of the invention or against Cologne 1-6 peptides are also useful for diagnostic assays that measure the presence of $T_{reg}$ cells expressing the protein of the invention or of Cologne 1-6 expressing $T_{reg}$ cells in a test sample. For example, the presence (or increased levels) of Cologne 1-6 expressing $T_{reg}$ cells in a sample from a subject who has received an therapy, relative to the level of Cologne 1-6 expressing $T_{reg}$ cells in a reference sample (such as a pretherapy sample from the patient), indicates that the patient has responded to the given therapy.

Purified peptides of the protein of the invention or Cologne 1-6 peptides can also be useful for diagnostic assays that measure the presence of Cologne 1-6 specific CTLs in a test sample. For example, the presence (or increased levels) of Cologne 1-6 specific CTLs in a sample from a subject who has received an anti-Cologne 1-6 vaccination, relative to the level of Cologne 1-6 specific CTLs in a reference sample (such as a pre-vaccination sample from the patient), indicates that the patient has mounted a Cologne 1-6 specific immune response.

The peptides of the protein of the invention or Cologne 1-6 peptides can be produced by chemical synthesis (e.g., by the methods described in Solid Phase Peptide Synthesis, 2nd ed., 1984, The Pierce Chemical Co., Rockford, Ill., or by other methods known to those skilled in the art of peptide synthesis).

A wide variety of expression systems can be used to recombinantly produce the proteins of the invention and peptides thereof, notably the Cologne 1-6 peptides, polypeptides, fragments, fusion proteins, and amino acid sequence variants. The proteins of the invention and Cologne 1-6 peptides can be produced in prokaryotic hosts (e.g., *E. coli*) or in eukaryotic hosts (ag., *S. cerevisiae*, insect cells, such as Sf9 cells, or mammalian cells, such as COS-1, NIH 3T3, Jurkat, 293, 293T, or HeLa cells). These cells are commercially available from, for example, the American Type Culture Collection, Rockville, Md. (also see, e.g., Ausubel et al., *Current Protocols in Molecular Biology*, John Wiley & Sons, New York, N.Y., 1998). The method of transformation and the choice of expression vehicle (e.g., expression vector) depends on the host system selected. Transformation and transfection methods are described, e.g., by Ausubel et al., supra, and expression vehicles can be chosen from the numerous examples that are known in this field.

First, a nucleic acid molecule encoding the protein of the invention or the Cologne 1-6 peptide is introduced into a plasmid or other vector, which is then used to transform living cells. Constructs in which a cDNA containing the entire coding sequence of the protein of the invention or Cologne 1-6 coding sequence, a fragment of such coding sequence, an amino acid variations of such coding sequence, or fusion proteins of the aforementioned, inserted in the correct orientation into an expression plasmid, can be used for protein expression. Prokaryotic and eukaryotic expression systems allow various immunogenic domains of the protein of the invention or Cologne 1-6 peptides or polypeptides to be recovered as fusion proteins, and then used for the generation of antibodies specified for the protein of the invention or of Cologne 1-6 specific antibodies but also CTLs. In some cases, for example, when a protein of the invention or a Cologne 1-6 peptide is to be expressed directly within a cell, it may be desirable to express the protein of the invention or of Cologne 1-6 peptide under the control of an inducible or tissue-specific promoter.

Typical expression vectors contain promoters that direct the synthesis of large amounts of mRNA corresponding to the inserted protein of the invention—(Cologne 1-6 peptide —) encoding nucleic acid molecule in the plasmid-bearing cells. They can also include eukaryotic or prokaryotic "origin of replication" sequences, which allow for their autonomous replication within the host organism, sequences that encode genetic traits that allow vector-containing cells to be selected in the presence of otherwise toxic drugs (such as antibiotics), and sequences that increase the efficiency with which the synthesized mRNA is translated. Stable, long-term vectors can be maintained as freely replicating entities within cells by using regulatory elements of, for example, viruses (e.g., the OriP sequences from the Epstein Barr Virus genome). Cell lines can also be produced that have the vector integrated into genomic DNA, and, in this manner, the gene product is produced on a continuous basis.

Expression of foreign sequences in bacteria such as *Escherichia coli* requires insertion of a nucleic acid molecule encoding a polypeptide into a bacterial expression vector. Plasmid vectors in this category contain several elements required for propagation of the plasmid in bacteria and expression of inserted DNA of the plasmid by the plasmid-carrying bacteria. Propagation of only plasmid-bearing bacteria is achieved by introducing into the plasmid selectable marker-encoding sequences that allow plasmid-bearing bacteria to grow in the presence of otherwise toxic drugs (e.g., antibiotics). The plasmid also includes a transcriptional promoter that is capable of producing large amounts of mRNA from the cloned gene. Such promoters may or may not be inducible promoters. The plasmid also, preferably, contains a polylinker to simplify insertion of the gene in the correct orientation within the vector. For example, in a simple *E. coli* expression vector utilizing the lac promoter, the expression vector plasmid contains a fragment of the *E. coli* chromosome containing the lac promoter and the neighboring lacZ gene. In the presence of the lactose analog IPTG, RNA polymerase normally transcribes the lacZ gene, producing lacZ mRNA, which is translated into the encoded protein, P-galactosidase. The lacZ gene can be cut out of the expression vector with restriction endonucleases and replaced by a gene sequence of the protein of the invention or a Cologne 1-6 peptide gene sequence, or a fragment, fusion, or mutant thereof. When the resulting plasmid is transfected into *E. coli*, addition of IPTG and subsequent transcription from the lac promoter produces mRNA encoding the protein of the invention or the Cologne 1-6 polypeptide of interest, which is then translated into a polypeptide.

Once the appropriate expression vector containing a gene of the protein of the invention or a Cologne 1-6 gene is constructed, it is introduced into an appropriate host cell by transformation, transfection, or transduction techniques that are known in the art, including calcium chloride transformation, calcium phosphate transfection, DEAE-dextran transfection, electroporation, microinjection, protoplast fusion, and liposome-mediated transfection. The host cells that are transformed with the vectors of this invention can include (but are not limited to) *E. coli* or other bacteria, yeast, fungi, insect cells (using, for example, baculoviral vectors for expression), human, mouse, or other animal cells. Mammalian cells can also be used to express the protein of the invention of the Cologne 1-6 peptides using a vaccinia virus expression system, as is described by Ausubel et al., supra.

In vitro expression of the protein of the invention or of Cologne 1-6 peptides, proteins, fusions, polypeptide fragments, or mutated versions thereof encoded by cloned DNA is also possible using the T7 late promoter expression system. Plasmid vectors containing late promoters and the corresponding RNA polymerases from related bacteriophages such as T3, T5, and SP6 can also be used for in vitro production of proteins from cloned DNA. *E. coli* can also be used for expression using an M13 phage such as mGPI-2. Furthermore, vectors that contain phage lambda regulatory sequences, or vectors that direct the expression of fusion proteins, for example, a maltosebinding protein fusion protein or a 'glutathiones-transferase fusion protein, also can be used for expression in *E. coli*. Eukaryotic expression systems permit appropriate post-translational modifications to expressed proteins. Transient transfection of a eukaryotic expression plasmid allows the transient production of the proteins of the invention or of Cologne 1-6 peptides by a transfected host cell. The proteins of the invention of Cologne 1-6 peptides can also be produced by a stably-transfected mammalian cell line. A number of vectors suitable for stable transfection of mammalian cells are available to the public (e.g., see Pouwels et al, *Cloning Vectors: A Laboratory Manual*, 1985, Supp. 2, 987), as are methods for constructing such cell lines (see, e.g., Ausubel et al., supra). In one example, cDNA encoding a protein of the invention or a Cologne 1-6 peptide, protein, fragment, mutant, or fusion protein is cloned into an expression vector that includes the dihydrofolate reductase (DHFR) gene. Integration of the plasmid and, therefore, integration of the gene encoding the protein of the invention or the Cologne 1-6 peptide-encoding genes into the host cell chromosome is selected by inclusion of 0.01-300 µM methotrexate in the cell culture medium (as is described by Ausubel et al., supra). This dominant selection can be accomplished in most cell types. Recombinant protein expression can be increased by DHFR-mediated amplification of the transfected gene. Methods for selecting cell lines bearing gene amplifications are described by Ausubel et al., supra. These methods generally involve extended culture in medium containing gradually increasing levels of methotrexate. The most commonly used DHFR-containing expression vectors are pCVSEII-DHFR and pAdD26SV(A) (described by Ausubel et al., supra). The host cells described above or, preferably, a DHFR-deficient CHO cell line (e.g., CHO DHFR-cells, ATCC Accession No. CRL 9096) are among those most preferred for DHFR selection of a stably-transfected cell line or DHFR-mediated gene amplification. Other drug markers can be analogously used.

Expression of proteins of the invention, such as those containing Cologne 1-6 peptides, in eukaryotic cells allows the production of large amounts of normal or mutant proteins for isolation and purification, and the use of cells expressing a Cologne 1-6 peptide-containing protein provides a functional assay system for antibodies generated against a Cologne 1-6 peptide of interest.

Another preferred eukaryotic expression system is the trc expression vector system using, for example, the vector pTrcHis, which is available from Invitrogen (Karlsruhe, Germany). If desired, this system can be used to express the proteins of the invention or Cologne 1-6 in conjunction with other protein tags, for example, the myc, His, or XPRESS tag as known in the art.

Once a recombinant protein of the invention or Cologne 1-6 protein is expressed, it can be isolated from the expressing cells by cell lysis followed by protein purification techniques, such as affinity chromatography. In this example, an anti-XPRESS antibody can be attached to a column and used to isolate the recombinant protein of the invention or the recombinant Cologne 1-6 peptide-containing proteins. Lysis and fractionation of Cologne 1-6 peptide-harboring cells prior to affinity chromatography can be performed by standard methods (see, e.g., Ausubel et al., supra). Once isolated, the recombinant protein can, if desired, be purified further, e.g., by high performance liquid chromatography (HPLC; e.g., see Fisher, *Laboratory Techniques in Biochemistry and Molecular Biology*, Work and Burdon, Eds., Elsevier, 1980).

For antibody production the protein of the invention or Cologne 1-6 or a MHC-binding peptide thereof is administered to an animal in association with an adjuvant. For example, a chemical antigen (e.g., Freund's incomplete adjuvant; cytoxan; an aluminum compound, such as aluminum hydroxide, aluminium phosphate, or aluminium hydroxyphosphate; liposomes; ISCOMS; rnicrospheres; protein chochleates; vesicles consisting of nonionic surfactants; cationic amphiphilic dispersions in water; oil/water emulsions; muramidyldipeptide (MDP) and its derivatives such as glucosyl murarnid dipeptide (GMDP), threonyl-MDP, murametide and murapalmitin; and QuilA and its subfractions; as well as various other compounds such as monophosphoryl-lipid A (MIPLA); gamma-inulin; calcitriol; and loxoribine) can be used.

Preferably, Cologne 1-6 or a MHC-binding peptide thereof is administered to a patient in association with an adjuvant. For example, a chemical antigen as decribed before can be used.

A biological response modifier, which is a soluble mediator that affects induction of an immune response, can also be used as an adjuvant. For example, cytokines (e.g., IL2 and GM-CSF), chemokines, co-stimulatory molecules (e.g., B7, ICAM, class I monoclonal antibodies, stem cell factor, and stimulated T cells) can be used. Also, bacterial products, such as toxins or, preferably, subunits or fragments thereof that have reduced (if any) toxicity, but maintained adjuvant activity. Additional types of adjuvant molecules that can be used in the invention include, for example, biological modifiers of the death response (e.g., apoptosis sensitizers) and compounds or treatment that increases the susceptibility of the target cell to treatment, such as radiation and chemotherapy. Also, increasing expression of the protein of the invention or Cologne 1-6 in the cell can increase susceptibility of the cell to treatment according to the invention.

Finally, as is described above, cellular adjuvants can be used in the immunization methods of the invention. For example, a peptide of the protein of the invention or a Cologne 1-6 peptide can be administered to a patient or an animal on the surface of an antigen presenting cell, in the context of MHC. In additional to professional antigen presenting cells, e.g., dendritic cells, CD40-activated B cells, irradiated $T_{reg}$ cells, alternative antigen presenting cells, synthetic antigen presenting cells (e.g., lipid mycels and artificial APC-like scaffolds), and fusions of any of the above-listed cells can be used.

As an alternative to vaccination with a protein of the invention or a peptide thereof, or a Cologne 1-6 protein or peptide, vaccination with a nucleic acid molecule that encodes such a protein or peptide can be used for vaccination. Such nucleic acid molecules can be administered as "naked" DNA molecules, present in a plasmid or viral vector, or packaged into a liposome or cell, such as eukaryotic cell, prior to administration. The nucleic acid molecules can be administered in vivo, or can be used to treat a cell ex vivo (e.g., an antigen presenting cell, such as a dendritic cell or a CD40-activated B cell), which is then administered. Alternatively, RNA, e.g., mRNA, can be used in these methods (Boczkowski et al., J. Exp. Med.; 184: 465-472 (1996)).

For in vivo expression, a gene that encodes a polypeptide that includes a protein of the invention or Cologne 1-6 or an MHC-binding peptide thereof must be delivered to cells in a form that can be taken up by the cells, in which a sufficient level of protein is expressed to induce an effective immune response. Retroviral, adenoviral, lentiviral, poxviral, and other viral vectors are suited as nucleic acid expression vectors for in vivo delivery, because they show efficient infection and/or integration and expression; (Cayouette and Gravel, Hum. Gene Ther.; 8: 423-430 (1997); Kido et al., Curr. Eye Res.; 15: 833-844 (1996); Miyoshi et al., Proc. Natl. Acad. Sci. USA; 94: 10319-10323 (1997); Naldini et al., Science; 272: 263-267 (1996)). For example, any DNA fragment that encodes a polypeptide that contains a peptide of a protein of the invention or a Cologne 1-6 peptide can be cloned into a retroviral aor lentiviral vector and transcribed via its endogenous promoter, via an exogenous promoter, via a promoter specific for the target cell type of interest, or, in the case of retroviral or lentiviral vectors, via the viral long terminal repeat. Other viral vectors that can be used include adenovirus, adenoassociated virus, poxviruses, such as vaccinia virus or bovine papilloma virus, or a herpes virus, such as Epstein-Barr Virus.

Gene transfer in vivo can also be achieved by non-viral means. For example, a plasmid vector that encodes a polypeptide that contains a peptide of a protein of the invention or a Cologne 1-6 peptide can be injected directly into skeletal muscle or cardiac muscle by previously described methods (Wolff et al., *Science;* 247: 1465-1468 (1990)). Expression vectors injected into skeletal muscle in situ are taken up into muscle cell nuclei and used as templates for expression of their encoded proteins. Cologne 1-6 peptide-encoding genes that are engineered to contain a signal peptide are secreted from Cologne 1-6 peptide-expressing muscle cells, after which they induce an immune response. Gene transfer into cells within the tissues of a living animal also can be achieved by Lipofection (Brigham et al., Am. J. Med. Sci.; 298: 278-281 (1989); Feigner et al., Proc. Natl. Acad. Sci. USA; 84: 7413-7417 (1987); Ono et al., Neurosci. Lett.; 117: 259-263 (1990)), or asialoorosomucoid-polylysine conjugation (Wu et al., J. Biol. Chem.; 264: 16985-16987 (1989); Wu and Wu, J. Biol. Chem.; 263: 14621-14624 (1988)), and analogous methods.

Retroviral vectors, adenoviral vectors, adenovirus-associated viral vectors, or other viral vectors also can be used to deliver genes encoding Cologne 1-6 peptides or polypeptides to cells ex vivo. Numerous vectors useful for this purpose are generally known (Anderson, Science; 224: 340 (1984); Cornetta et al., Prog. Nucleic Acid. Res. Mol. Biol.; 36: 311-322 (1989); Eglitis et al., Adv. Exp. Med. Biol; 241: 19-27 (1988); Friedmann, Science; 244: 1275-1281 (1989); Johnson, Chest; 107: 77S-83S (1995); Le Gal La Salle et al., Science; 259: 988-990 (1993); Miller, Hum. Gene. Ther.; 1: 5-14 (1990); Moen, Blood Cells; 17: 407-416 (1991); Tolstoshev and Anderson, Curr. Opin. Biotechnol.; 1: 55-61 (1990)). Retroviral vectors are particularly well developed and have been used in clinical settings (Rosenberg et al., N. Engl. J. Med.; 323: 570-578 (1990)); Anderson et al., U.S. Pat. No. 5,399,346).

Gene transfer into cells ex vivo can also be achieved by delivery of nonviral vectors, such as expression plasmids, using methods such as calcium phosphate or DEAE dextran transfection, electroporation, and protoplast fusion. Liposomes can also be potentially beneficial for delivery of DNA into a cell.

Cells that are to be transduced or transfected ex vivo can be obtained from an animal or a patient (e.g., peripheral blood cells, such as $T_{reg}$ cells, B cells or dendritic cells, bone marrow stem cells, or cells from a tumor biopsy) prior to transfection, and reintroduced after transfection. However, the cells also can be derived from a source other than the patient or animal undergoing gene transfer. In the constructs described above, Cologne 1-6 peptide expression can be directed from any suitable promoter (e.g., the human cytomegalovirus (CMV), simian virus 40 (SV40), or metallothionein promoters), and regulated by any appropriate mammalian regulatory element. For example, if desired, enhancers known to preferentially direct gene expression in skeletal muscle cells can be used to direct Cologne 1-6 peptide expression for vaccination in situ. The enhancers used can include, without limitation, those that are characterized as tissue- or cells specific in their expression.

Conventional pharmaceutical practice can be employed to provide suitable formulations or compositions to administer antibodies against the proteins of the invention or Cologne 1-6 antibodies, peptide or nucleic acid vaccinations for treatment of, or prophylaxis against, increased $T_{reg}$ cell frequencies. The antibodies against the proteins of the invention or Cologne 1-6 antibodies, the peptides of the proteins of the invention or Cologne 1-6 peptides, the proteins of the invention or Cologne 1-6 polypeptides, and nucleic acid molecules coding therefor can be administered within a pharmaceutically-acceptable diluent, carrier, or excipient, in unit dosage form. Administration can begin before a patient is symptomatic. Any appropriate route of administration can be employed, for example, administration can be parenteral, intravenous, intra-arterial, subcutaneous, intramuscular, intracranial, intraorbital, ophthalmic, intraventricular, intracapsular, intraspinal, intracisternal, intraperitoneal, intranasal, aerosol, by suppositories, or oral administration. Therapeutic formulations can be in the form of liquid solutions or suspensions; for oral administration, formulations can be in the form of tablets or capsules; and for intraanasal formulations, in the form of powders, nasal drops, or aerosols. An adjuvant, e.g., as listed above, can be included with the formulation.

Methods well known in the art for making formulations are found, for example, in Remington's Pharmaceutical Sciences, (18th edition), ed. A. Gennaro, 1990, Mack Publishing Company, Easton, Pa. Formulations for parenteral administration can, for example, contain excipients, sterile water, or saline, .polyalkylene glycols such as polyethylene glycol, oils of vegetable origin, or hydrogenated napthalenes. Biocompatible, biodegradable lactide polymer, lactidelglycolide copolymer, or polyoxyethylene-polyoxypropylene copolymers can be used to control the release of the compounds. Other potentially useful parenteral delivery systems for the above mentioned peptides, proteins/polypeptides, and nucleic acid molecules include ethylene-vinyl acetate copolymer particles, osmotic pumps, implantable infusion systems, and liposomes. Formulations for inhalation can contain excipients, for example, lactose, or can be aqueous solutions containing, for example, polyoxyethylene-9-lauxyl ether, glycocholate and deoxycholate, or can be oily solutions for administration in the form of nasal drops, or as a gel.

As is mentioned above, in addition to the vaccination methods described above, which result in the activation of antigen-specific, MHC-restricted CTLs in vivo, such cells (i.e., antigen-specific, MHC-restricted CTLs) can be generated in vitro, and then administered to patients. Any cell that expresses an endogenous or exogenously-introduced major histocompatibility antigen-encoding gene can be used to present a peptide of the proteins of the invention or a Cologne 1-6 peptide to generate CTLs specific for the proteins of the invention or Cologne 1-6 specific CTLs in vitro. In one variation of this approach, a peptide-presenting cell expresses an endogenously or exogenously-introduced gene coding for a protein of the invention or Cologne 1-6 polypeptide-encoding gene. Expression of endogenous Cologne 1-6 in antigen-presenting cells can be stimulated by cytokines, such as IL-2, or by other molecules that are known to those of skill in this art to stimulate the expression of the protein of the invention or Cologne 1-6 expression. In another variation, the antigen presenting cells are pulsed with the proteins of the invention or with Cologne 1-6 or MHC-binding peptides thereof, and the pulsed cells are then used to generate CTLs for administration to a patient. Preferably, the CTLs used in these methods are obtained from the patient to whom they are to ultimately be administered (i. e., the cells are autologous). Alternatively, donor cells (.-e., allogeneic cells) can be used in this method. Finally, methods in which any of the above-described immunotherapeutic approaches are combined are included in the invention. For example, a patient may be treated with an antibody against a protein of the invention or a Cologne 1-6 antibody, and/or ex vivo, CTLs activated with the protein of the invention or Cologne 1-6 activated CTL and/or an ex vivo, protein of the invention or Cologne 1-6 pulsed APC (e.g., a DC or a CD40-activated B cell), and this treatment can be carried out before, during, or after a vaccination approach (see above). In addition to combining the approaches, each approach (or a combination thereof) can employ multiple peptides of Cologne 1-6, peptides of other $T_{reg}$ cell specific antigens, or a combination thereof.

As is understood in the art, a "polypeptide" is a chain of amino acids linked to one another by peptide bonds. A "protein" can be made up of one or more polypeptides, while a "peptide" is generally understood to be (or include) a fragment of a polypeptide, and to consist of a chain of peptide bond-linked amino acids that is shorter in length than a full length polypeptide from which it may be derived.

"Cologne 1-6" or "Cologne 1-6 protein or "Cologne 1-6 polypeptide," refers to a full length, non-fragmented polypeptide of Cologne 1-6, while a "Cologne 1-6 peptide," is (or includes) a fragment of such a Cologne 1-6 polypeptide. Cologne 1-6 peptides can be of any length, up to just under the full length of a Cologne 1-6 polypeptide. However, for use in the context of MHC class I or II presentation, Cologne 1-6 peptides are of a relatively short length, such as, for example, eight, nine, ten, up to twenty amino acids. Also, a Cologne 1-6 peptide may include sequences that are not present in a corresponding Cologne 1-6 polypeptide, provided that the Cologne 1-6 peptide also includes a stretch of at least, for example, eight, nine, ten, up to twenty consecutive amino acids that have a sequence that is identical to a sequence of eight, nine, ten, up to twentyconsecutive amino acids in a Cologne 1-6 polypeptide.

Peptides including amino acid substitutions can also be considered as Cologne 1-6 peptides. For example, a Cologne 1-6 peptide can include a region of at least nine amino acids, of which any six or more are identical to the amino acids within a nine amino acid stretch in Cologne 1-6. Preferably, at least seven, more preferably, at least eight, and, most preferably, all nine of the amino acids in a Cologne 1-6 peptide nine amino acid region are identical to a nine amino acid region in Cologne 1-6.

A Cologne 1-6 polypeptide corresponding to Cologne 1-6 includes the appropriate amount of amino acids that are substantially identical (see below) to the amino acid sequence of the respective Cologne 1-6 gene (Genbank Accession No.: Cologne 1 NM_145235, Cologne 2 NM_145307, Cologne 3 NM_000860, Cologne 4 NM_015535, Cologne 5 NM_018166, Cologne 6 NM_207423), or such a polypeptide can include the amino acid sequence of Cologmne 1-6, as well as additional sequences.

As is discussed further below, it is preferable that Cologne 1-6 polypeptides of the invention include regions that can either act as antigens for the generation of polyclonal or monoclonal antibodies or can bind to major histocompatibility complex (MHC) antigens. Corresponding peptides can be identified using methods described below (also see PCT/US99/25438). A Cologne 1-6 peptide or polypeptide can be fused to amino acid sequences that do not naturally occur in Cologne 1-6. Moreover, a Cologne 1-6 peptide or polypeptide can be attached to the surface of a cell or to a molecule or a macromolecule (e.g., a histocompatibility antigen), or a Cologne 1-6 peptide or polypeptide can be conjugated to immunogens or adjuvants that are known to those of skill in this art, for example, keyhole limpet hemocyanin (KLH), for the purpose of eliciting a Cologne 1-6 specific immune response, for example generation of polyclonal or monoclonal antibodies. By "Cologne 1-6 nucleic acid molecule" is meant a DNA or RNA (e.g., mRNA) molecule that encodes a Cologne 1-6 polypeptide or Cologne 1-6 peptide, as are defined above.

By "Cologne 1-6 expressing $T_{reg}$ cell" is meant a $T_{reg}$ cell as defined above that expresses Cologne 1-6. A Cologne 1-6 expressing $T_{reg}$ cell can express a level of Cologne 1-6 that is equal to, or, preferably, greater than the level of Cologne 1-6 expressed by normal human somatic or germ line cells. Cologne 1-6 expression levels in a Cologne 1-6 expressing $T_{reg}$ cell can be increased by, for example, stimulation through the T-cell receptor and/or co-stimulation, for example CD28 stimulation, increased transcription of the Cologne 1-6 gene, increased Cologne 1-6 mRNA stability or translation, increased Cologne 1-6 polypeptide stability, or increased Cologne 1-6 enzymatic activity. Increasing such Cologne 1-6 expression levels may be useful in the invention to increase the likelihood that a $T_{reg}$-cell will be recognized as a target of the immunotherapeutic methods described herein (see below).

By "histocompatibility antigen" is meant a molecule, such as a major histocompatibility complex (MHC) class I, MHC class II, or minor histocompatibility antigen, that mediates interactions of cells of the immune system with each other and with other cell types. Examples of histocompatibility antigens include MHC class I antigens, such as HLA-A (e.g., A1, A2, A3, A11, A24, A31, A33, and A38), HLA-B, and HLA-C, MHC class II antigens, such as HLA-DR, HLA-DQ, HLA-DX, HLA-DO, HLA-DZ, and HLA-DP, and minor histocompatibility antigens, such as HA-1.

By "generating CTLs" is meant an in vivo, in vitro, or ex vivo process by which CTLs (e.g., Cologne 1-6 specific CTLs) are activated (e.g., stimulated to grow and divide) and/or selected.

A peptide of Cologne 1-6 is said to "specifically bind" to an MHC antigen if the peptide adheres to a histocompatibility antigen under physiological conditions. For example, such binding can be similar to that of a peptide antigen that is naturally processed and presented in the context of MHC in an antigen presenting cell.

An antibody or cytotoxic T lymphocyte (CTL) is said to "specifically recognize" a polypeptide of the invention or a Cologne 1-6 polypeptide or a Cologne 1-6 peptide if it binds to the polypeptide or peptide, but does not substantially bind to other, unrelated polypeptides or peptides.

A CTL is said to "specifically kill" a cell if it specifically recognizes and lyses a cell that expresses an antigen (e.g., Cologne 1-6) to which it has been activated, but does not substantially recognize or lyse cells not expressing the antigen. In the case of Cologne 1-6, such a CTL is designated as a "Cologne 1-6 specific CTL" herein.

By "Cologne 1-6 specific antibody" is meant an antibody that can specifically recognize and bind to a Cologne 1-6 peptide or polypeptide, and that does not substantially recognize and bind to other, unrelated molecules.

A Cologne 1-6 polypeptide is "presented" if a peptide of Cologne 1-6 is displayed on the extracellular surface of a cell (e.g., an antigen presenting cell), such that it can result in the in vivo, ex vivo, or in vitro generation of Cologne 1-6 specific CTLs or the lysis of a Cologne 1-6 expressing $T_{reg}$ cell by a Cologne 1-6 specific CTL. Preferably, the displayed Cologne 1-6 peptide is bound to a histocompatibility antigen.

By "physiological conditions" is meant the in vivo environment in which Cologne 1-6 specific CTLs are generated (activated and/or selected) and perform their biological functions (e.g., recognition of a Cologne 1-6 peptide and MHC-restricted lysis of Cologne 1-6 expressing $T_{reg}$ cells), or an in vitto or ex vivo environment that allows Cologne 1-6 specific CTLs to be generated and to perform their biological functions.

By "Cologne 1-6 vaccination" is meant administration of an immunogenic preparation including one or more Cologne 1-6 peptides, Cologne 1-6 polypeptides, Cologne 1-6 nucleic acid molecules, fragments of any of these molecules, Cologne 1-6 presenting cells (e.g., dendritic cells or CD40-activated B cells), or mixtures thereof. Vaccination is performed on a subject who has pathologically increased levels of $T_{reg}$ cells, has a history of having pathologically increased levels of $T_{reg}$ cells, is likely to develop pathologically increased levels of $T_{reg}$ cells, or any healthy individual to prevent pathologically increased levels of $T_{reg}$ cells, or on a subject in which Cologne 1-6 specific immune cells (such as CTLs) are to be generated for transfer into a patient. Such vaccination stimulates a Cologne 1-6 specific immune response within the subject. In subjects having pathologically increased levels of $T_{reg}$ cells, the vaccination can result in partial or complete depletion of $T_{reg}$ cells, provided that the patient's $T_{reg}$ cells expresses Cologne 1-6. In addition, vaccination can provide prophylaxis against the development of new Cologne 1-6 expressing $T_{reg}$ cells.

A "vaccine," as used herein, is an immunogenic composition that can be administered in the vaccination method described above. Thus, a vaccine includes, for example, one or more Cologne 1-6 peptides, Cologne 1-6 polypeptides, Cologne 1-6 nucleic acid molecules, fragments of any of these molecules, Cologne 1-6 presenting cells (e.g., dendritic cells or CD40-activated B cells), or mixtures thereof. Optionally, a vaccine composition can also include an adjuvant, which is a molecule that stimulates an immune response to a co-administered vaccine antigen. Examples of adjuvants that can be used in the invention are provided below. A vaccine composition can also include other $T_{reg}$ cell associated antigens or peptides thereof.

By "immune cell" is meant any cell that plays a role in cell-mediated or humoral immunity, including CTLs and antigen-presenting cells, e.g., B cells, T helper cells, and dendritic cells.

By "sample" is meant a tumor or tissue biopsy, a lymph node biopsy, bone marrow, cells, blood, serum, urine, stool, sputum, saliva, or other specimen obtained from a patient. A sample can be analyzed to determine the level of Cologne 1-6 expressing $T_{reg}$ cells, Cologne 1-6 specific CTLs, or the level of any other immune response indicator (e.g., a cytokine) in the patient from whom it was taken by methods that are known in the art. For example, flow cytometry can be used to measure levels of Cologne 1-6 expressing $T_{reg}$ cells, and ELISPOT can be used to measure cytokine levels. Also, $Cr^{51}$ release (T cell cytotoxicity) assays and assays that test the binding of CTLs to tetrameric Cologne 1-6 peptide/MHC complexes, can be used to measure levels of Cologne 1-6 specific CTLs.

By "reference sample" is meant a sample in which the level of Cologne 1-6 specific CTLs or the level of Cologne 1-6 expressing $T_{reg}$ cells have been measured, and to which the level of Cologne 1-6 specific CTLs or the level of Cologne 1-6 expressing $T_{reg}$ cells in a test subject's sample are compared. Reference Levels can be higher, lower, or the same as patient sample levels. Comparison of a test sample to a reference sample provides an assessment of the levels of Cologne 1-6 expressing $T_{reg}$ cells or Cologne 1-6 specific immune response in the test subject By "$T_{reg}$ cell elimination" is meant any therapy (e.g., chemotherapy, radiation therapy, administration of a Cologne 1-6 specific CTLs, administration of an APC presenting a peptide of Cologne 1-6 or vaccination with Cologne 1-6, a nucleic acid molecule encoding Cologne 1-6, or a fragment thereof, to enhance an anti $T_{reg}$ cell immune response) administered either alone or in combination with other therapies, that influences $T_{reg}$ cell frequencies in at least some patients to which the treatment is administered. For example, $T_{reg}$ cell elimination can partially or completely reduce or inhibit $T_{reg}$ cells. Furthermore, $T_{reg}$ cell elimination can be prophylactic, in that it inhibits or prevents the development of new $T_{reg}$ cells in healthy individuals, in patients that are in remission from cancer, have metastatic cancer, or have a high risk of developing cancer.

By "inhibiting the development of $T_{reg}$ cells" is meant administering a protective therapy (such Cologne 1-6 specific CTLs, Cologne 1-6 peptide presenting APCs, or a vaccine including, for example, one or more Cologne 1-6 peptides, Cologne 1-6 polypeptides, or Cologne 1-6 nucleic acid molecules, or a combination thereof) to a subject adjudged to have a higher than average risk of developing high frequencies of $T_{reg}$ cells.

By "pharmaceutically acceptable carrier" is meant a carrier that is physiologically acceptable to a patient, while retaining the therapeutic properties of the compound with which it is administered. One exemplary pharmaceutically acceptable carrier is physiological saline. Other physiologically acceptable carriers and their formulations are known to those skilled in the art, and are described, for example, in Remington's Pharmaceutical Sciences (18th edition), ed. A. Gennaro, 1990, Mack Publishing Company, Easton, Pa.

The term "substantially identical" is used herein to describe a polypeptide or nucleic acid molecule exhibiting at least 50%, preferably at least 85%, more preferably at least 90%, and most preferably at least 95% identity to a reference amino acid or nucleic acid sequence. For polypeptides, the length of comparison sequences is at least 8 amino acids, preferably at least 16 amino acids, more preferably at least 25 amino acids, and most preferably 35 amino acids. For nucleic acid molecules, the length of comparison sequences is at least 24 nucleotides, preferably at least 50 nucleotides, more preferably at least 75 nucleotides, and most preferably at least 1 10 nucleotides. Sequence identity is typically measured using sequence analysis software with the default parameters specified therein (e.g., Sequence Analysis Software Package of the Genetics Computer Group, University of Wisconsin Biotechnology Center, 17 10, University Avenue, Madison, Wis. 5 3 705). The Cologne 1-6 polypeptides, peptides, and nucleic acid molecules of the invention can be identical or substantially identical to naturally occurring molecules, and thus may or may not include nonwild type sequences. By "substantially pure peptide" or "substantially pure polypeptide" is meant a peptide, polypeptide, or a fragment thereof, which has been separated from the components that naturally accompany it. Typically, the peptide or polypeptide is substantially pure when it is at least 60%, by weight, free from the proteins and naturally occurring organic molecules with which it is naturally associated. Preferably, the peptide or polypeptide is a Cologne 1-6 peptide or polypeptide that is at least 75%, more preferably at least 90%, and most preferably at least 99%, by weight, pure. A substantially pure Cologne 1-6 peptide or polypeptide can be obtained, for example, by extraction from a natural source (e.g., a $T_{reg}$ cell), by expression of a recombinant nucleic acid molecule encoding a Cologne 1-6 peptide or polypeptide, or by chemically synthesizing the peptide or polypeptide. Purity can be measured by any appropriate method, e.g., by column chromatography, polyacrylamide gel electrophoresis, or HPLC analysis.

A protein is substantially free of naturally associated components when it is separated from those contaminants that accompany it in its natural state. Thus, a protein that is chemically synthesized or produced in a cellular system different from the cell from which it naturally originates is substantially free from its naturally associated components. Accordingly, substantially pure peptides and polypeptides not only include those derived from eukaryotic organisms, but also those synthesized in *E. coli* or other prokaryotes.

By "substantially pure DNA" or "isolated DNA" is meant DNA that is free of the genes that, in the naturally occurring genome of the organism from which the DNA is derived, flank the gene. The term thus includes, for example, a recombinant DNA that is incorporated into a vector; an autonomously replicating plasmid or virus; or the genomic DNA of a prokaryote or eukaryote; or DNA that exists as a separate molecule (e.g., a cDNA, or a genomic or cDNA fragment produced by PCR or restriction endonuclease digestion) independent of other sequences. It also includes a recombinant DNA that is part of a hybrid gene encoding additional polypeptide sequence.

By "transformation," "transfection," or "transduction" is meant any method for introducing foreign molecules into a cell. Lipofection, DEAE-dextran mediated transfection, microinjection, protoplast fusion, calcium phosphate precipitation, transduction (e.g., bacteriophage, adenoviral retroviral, lentiviral or other viral delivery), electroporation, and biolistic transformation are just a few of the methods known to those skilled in the art that can be used in the invention.

By "transformed cell," "transfected cell," or "transduced cell," is meant a cell (or a descendent of a cell) into which a nucleic acid molecule (e.g., a DNA or RNA molecule) encoding a polypeptide of the invention has been introduced by means of recombinant DNA techniques.

By "promoter" is meant a minimal sequence sufficient to direct transcription. Promoter elements that are sufficient to render promoter-dependent gene expression controllable for cell type-specific, tissue-specific, temporal-specific, or inducible by external signals or agents can also be used in the invention; such elements can be located in the 5' or 3' or intron sequence regions of the native gene.

By "operably linked" is meant that a gene and one or more regulatory sequences are connected in such a way as to permit gene expression when the appropriate molecules (e.g., transcriptional activator proteins) are bound to the regulatory sequences.

By "expression vector" is meant a genetically engineered plasmid or virus, derived from, for example, a bacteriophage, adenovirus, retrovirus, lentivirus, poxvirus, herpesvirus, or artificial chromosome, that is used to transfer a peptide or polypeptide coding sequence (e.g., a Cologne 1-6 peptide coding sequence), operably linked to a promoter, into a host cell, such that the encoded peptide or polypeptide is expressed within the host cell.

All publications and patent applications mentioned in this specification are herein incorporated by reference to the same extent as if each independent publication or patent application was specifically and individually indicated to be incorporated by reference. While the invention has been described in connection with specific embodiments thereof, it will be understood that it is capable of further modifications, and this application is intended to cover any variations, uses, or adaptations of the invention following, in general, the principles of the invention and including such departures from the present disclosure come within known or customary practice within the art to which the invention pertains and can be applied to the essential features hereinbefore set forth, and follows in the scope of the appended claims. The invention is moreover explained in more detail in the following examples that are, however, not to be construed as limiting the invention.

EXAMPLES

Material and Methods

Patients and Clinical Parameters:

For isolation of $CD4^+CD25^{high}$ $T_{reg}$ cells and conventional $CD4^+CD25^-$ T cells following approval by our institutional review board peripheral blood from 4 healthy individuals and 4 patients with chronic lymphatic leukemia (CLL) was obtained after informed consent. Patients included for phenotypical or functional analysis were untreated prior to investigation. Staging was performed according to the Binet classification for CLL.

For isolation of $CD4^+CD127^{low}$ $CD25^+FOXP3^+$ $T_{reg}$ cells and $CD4^+CD127^+CD25^{-low/int}$ $FOXP3^-$ T cells peripheral blood from 4 healthy individuals was obtained after informed consent and approval by our institutional review board.

Isolation of PBMC from Healthy Donors and CLL Patients:

Peripheral blood mononuclear cells (PBMC) were obtained using Ficoll/Hypaque (Amersham, Uppsala, Sweden) density centrifugation. Therefore heparinized blood samples were diluted 1:1 with RPMI and layered onto 15 ml of Ficoll/Hypaque. After centrifugation for 30 min at 450 g, the interphase was collected, washed twice with RPMI and cryopreserved in the gas phase of a liquid nitrogen tank in 10% DMSO and 90% FCS until further processing.

Isolation of $CD4^+CD25^{high}$ $T_{reg}$ Cells and Conventional $CD4^+CD25^-$ T Cells:

Briefly, after washing twice with RPMI, CD4 MACS® Beads (Miltenyi Biotec) were used for the isolation of $CD4^+$ T cells from PBMC according to the manufacturer's recommendations. After staining with CD25-PE and CD4-APC (both from BD) according to the manufacturer's recommendations, $CD4^+C25^-$ and $CD4^+CD25^{high}$ T cells were purified using a FACSDiVa™ Cell Sorter (BD Biosciences). Purity of the $CD4^+CD25^{high}$ $T_{reg}$ cell population was routinely checked and resulted in >90% $CD4^+CD25^{high}$ $T_{reg}$ cells after purification. After isolation cells were either lysed directly in TRIzol reagent (Invitrogen Life Technologies) and stored at −80° C. until further processing or lysed after an additional stimulated for 20 hours.

Polyclonal Stimulation $CD4^+CD25^{high}$ $T_{reg}$ Cells and Conventional $CD4^+CD25^-$ T Cells with CD3 and Interleukin-2:

To assess the effect of short-term polyclonal stimulation on the gene expression of $CD4^+CD25^{high}$ $T_{reg}$ cells and conventional $CD4^+CD25^-$ T cells, $1\times10^6$ cells of the respective T cell population were activated in X-Vivo 15 (BioWhittaker) with anti-CD3 (0.5 μg/ml, OKT-3) and IL-2 (10 IU/ml, Proleukin, Chiron) for 20 hours.

RNA Preparation, Microarray Hybridization and Microarray Data Processing:

RNA isolation and quantification was performed according to the manufacturer's recommendations (Qiagen). Biotin labeled cRNA preparation was performed using the Ambion Illumina RNA amplification kit (Ambion Europe, Huntington, Cambridgeshire, UK) according to the manufacturer's recommendations. 1.5 μg biotin labeled cRNA was hybridized to Sentrix whole genome bead chips 6×2 (Illumina, San Diego, Calif., USA) according to the manufacturer's recommendations and scanned on the Illumina BeadStation 500x. For data collection, assessment and statistical analysis we used Illumina BeadStudio software and dCHIP 1.3. The following filtering criteria were used for selection of differentially expressed genes: fold change ≥2, absolute difference in signal intensity between group means ≥50 and p value ≤0.05 (paired t-test).

Isolation of $CD4^+CD127^{low}$ $CD25^+$ $T_{reg}$ Cells, Conventional $CD4^+CD127^+CD25^{low}$ and Activated $CD4^+CD127^+CD25^{int}$ T Cells, RNA Preparation, Microarray Hybridization and Microarray Data Processing:

According to our analysis as well as two reports published in 2006 CD127, the IL-7 receptor α-chain, is the most specific surface molecule down regulated in $CD4^+CD25^+$ $T_{reg}$ cells. The expression of CD127 is inverse correlated with the expression of the $T_{reg}$ cell specific transcription factor FOXP. We therefore wanted to confirm the expression of the identified differentially expressed genes in the $CD4^+CD127^{low}$ $CD25^+$ $T_{reg}$ cell population as this population should be further enriched in $T_{reg}$ cells than the $CD4^+CD25^+$ $T_{reg}$ cell population.

After thawing CD4+ T cells were purified using the BD IMag™ Cell Separation System (BD Biosciences) with CD4 Particles according to the manufacturer's recommendations. After staining with CD127-Alexa 647, CD25-PE and CD4-PerCP-Cy5.5 (both from BD) according to the manufacturer's recommendations, $CD4^+CD127^{low}$ $CD25^+$ $T_{reg}$ cells, conventional $CD4^+CD127^+CD25^{low}$ and activated $CD4^+CD127^+CD25^{int}$ T cells were purified using a FACSDiVa™ Cell Sorter (BD Biosciences). Purity of the $CD4^+CD127^{low}$ $CD25^+FOXP3^+$ $T_{reg}$ cell population as measured by FOXP3 Alexa 488 staining was routinely checked and resulted in >95% $CD4^+CD25^{high}$ $T_{reg}$ cells after purification. RNA isolation and quantification, Biotin labeled cRNA preparation, hybridization, scanning, and statistical analysis was performed as described before. The criteria used for selection of differentially expressed genes were defined as already mentioned.

Example 1

Identification of $T_{reg}$ Core Genes

Aim of this study was to identify Genes showing unique expression in regulatory T cells ($T_{regs}$) compared to other conventional $CD4^+$ T cells were identified as follows and were designated the "core transcriptome" of $T_{regs}$. A total of 192 individual experiments interrogating conventional and $T_{regs}$ in different states of activation were performed. CD4+ T cells were isolated from peripheral blood and were subsequently separated into CD25$^+$ and CD25$^-$ cells. CD25$^-$ cells were either left unstimulated (resting) or were exposed to different stimuli. These included activation through αCD3 and αCD28 antibodies with or without addition of inhibitory signals (TGFβ, CTLA4, PGE2, PD1 and IL10). CD25+ cells were either left unstimulated, were exposed to activation by IL2 or were expanded using Rapamycin. FIG. 1 shows the complete workflow of all experiments performed. All samples are present in replicates with least n=3.

Figure 2:
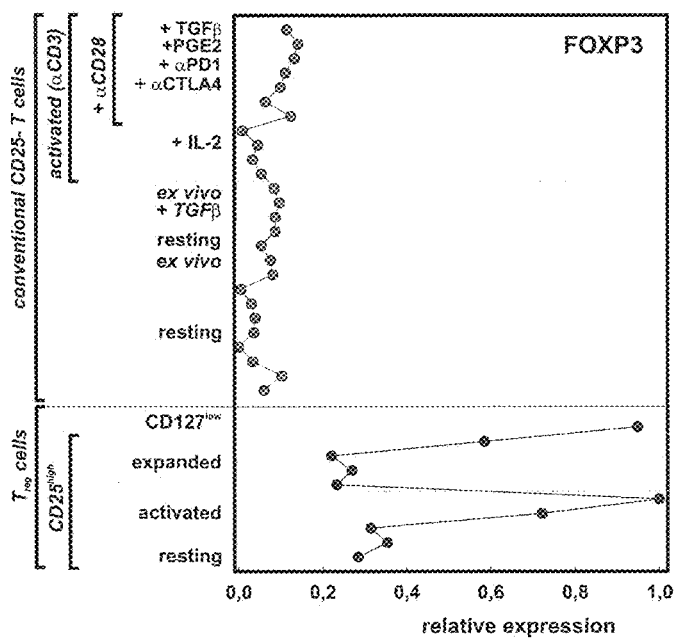
FIG. 2: Contour plot of FOXP3 depicting the expression values over the entire data set. Conventional T cells are shown in blue, $T_{reg}$ cells are shown in red.

To screen for potential candidate genes a pattern recognition approach was used. First, a virtual contour plot for each gene over the entire data set was generated. Then the correlation of each gene's expression profile and the expression profile of the positive control FOXP3 (FIG. 2) was determined. Genes with high positive respectively negative correlation to FOXP3 were then selected as core transcriptome associated genes.

Figure 3:
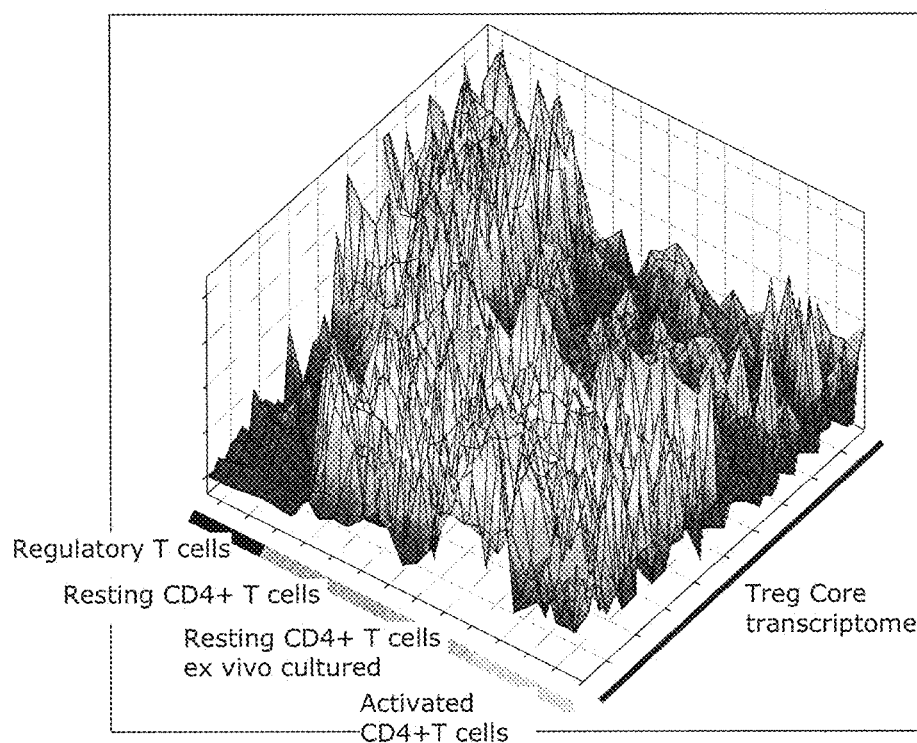
FIG. 3: Three-dimensional contour plot of genes included in the $T_{reg}$ core transcriptome
Figure 4:
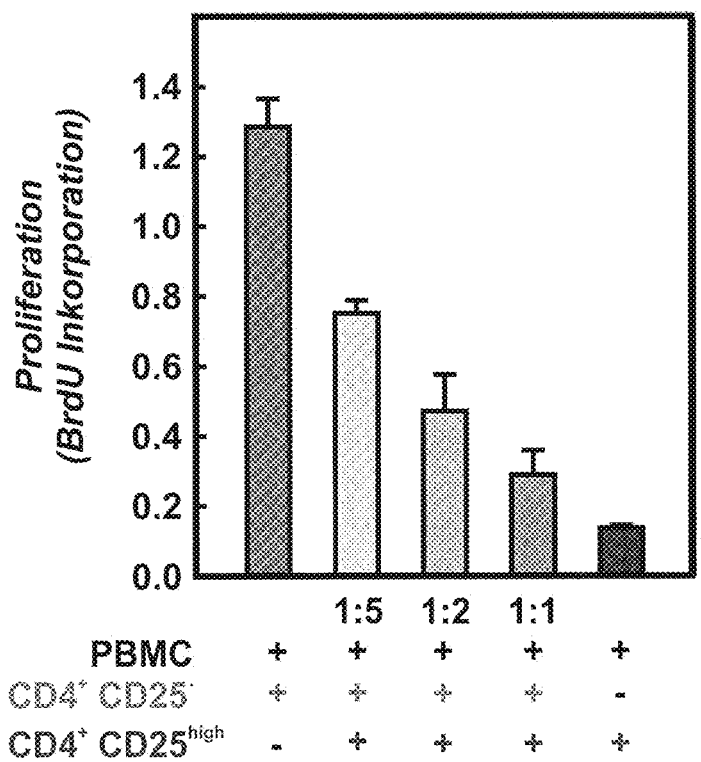
FIG. 4: Inhibitory potential of regulatory T cells. Conventional CD4$^+$ T cells are stimulated with allogene PBMCs alone or in combination with different concentrations of $T_{reg}$ cells. T cell proliferation was measured by BrdU incorporation.
Figure 5:
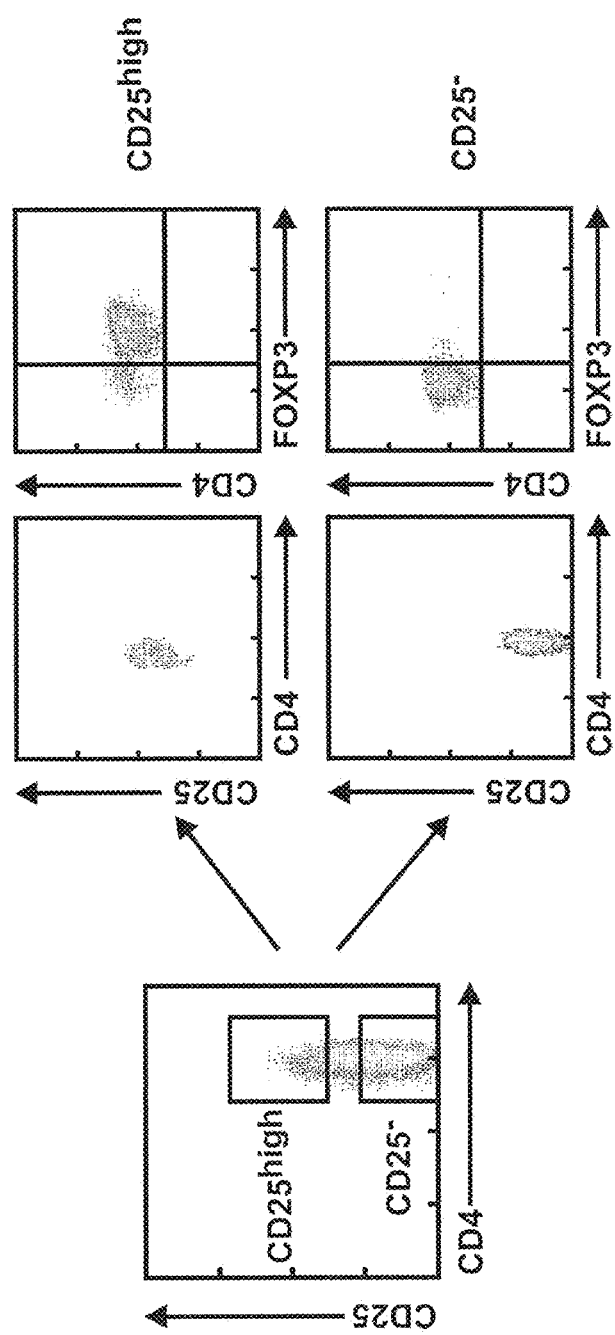
FIG. 5: Sorting strategy for CD4$^+$CD25$^{high}$ vs. CD4$^+$ CD25$^-$ T cells.
Figure 6:
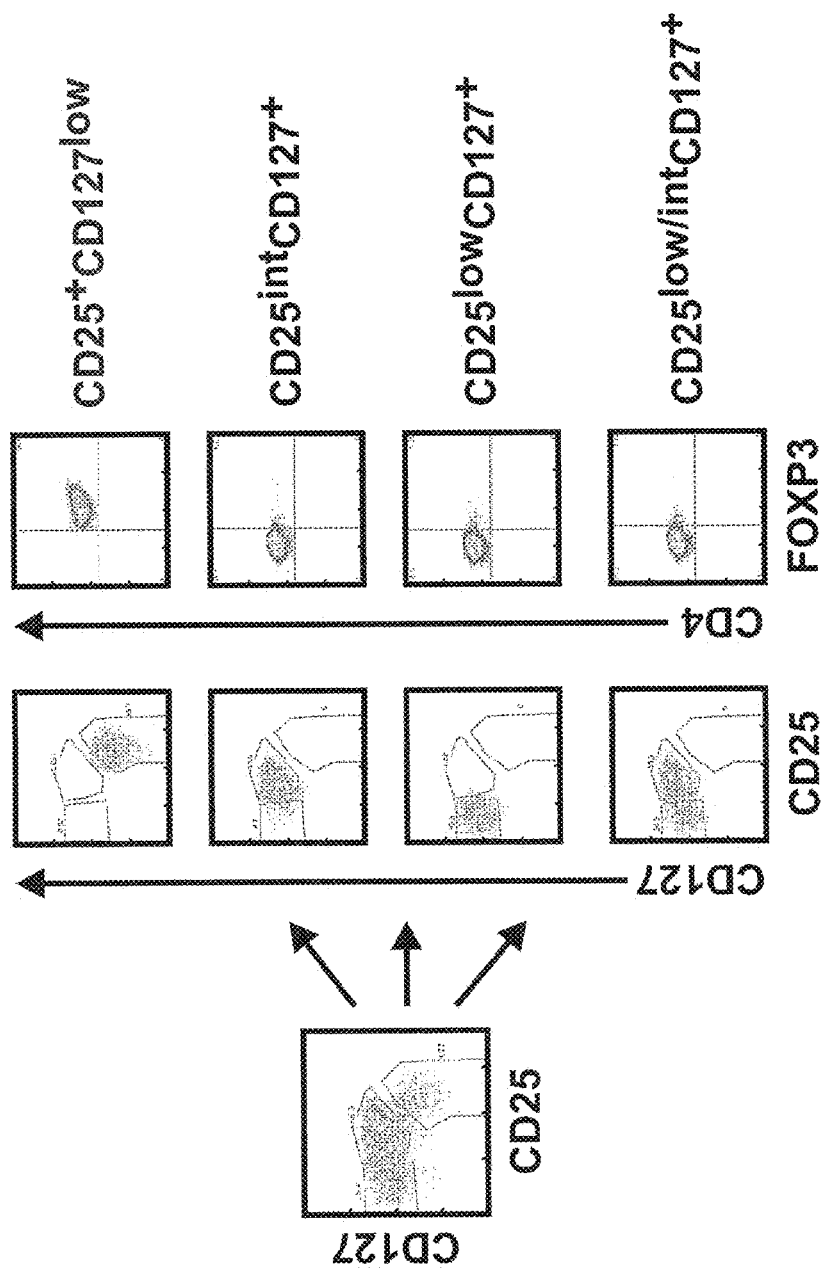
FIG. 6: Sorting strategy for $T_{reg}$ cells vs. conventional CD4$^+$ T cells integrating CD127. In this figure the sorting strategy for $T_{reg}$ cells vs. conventional CD4$^+$ T cells is shown integrating CD127 as a lineage marker.
Figure 7:
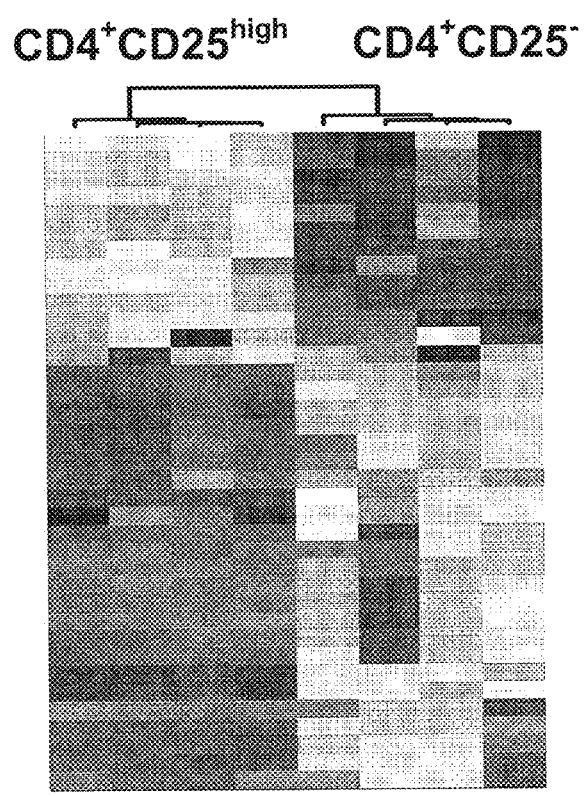
FIG. 7: Cluster analysis was performed on variable genes.
Figure 8:
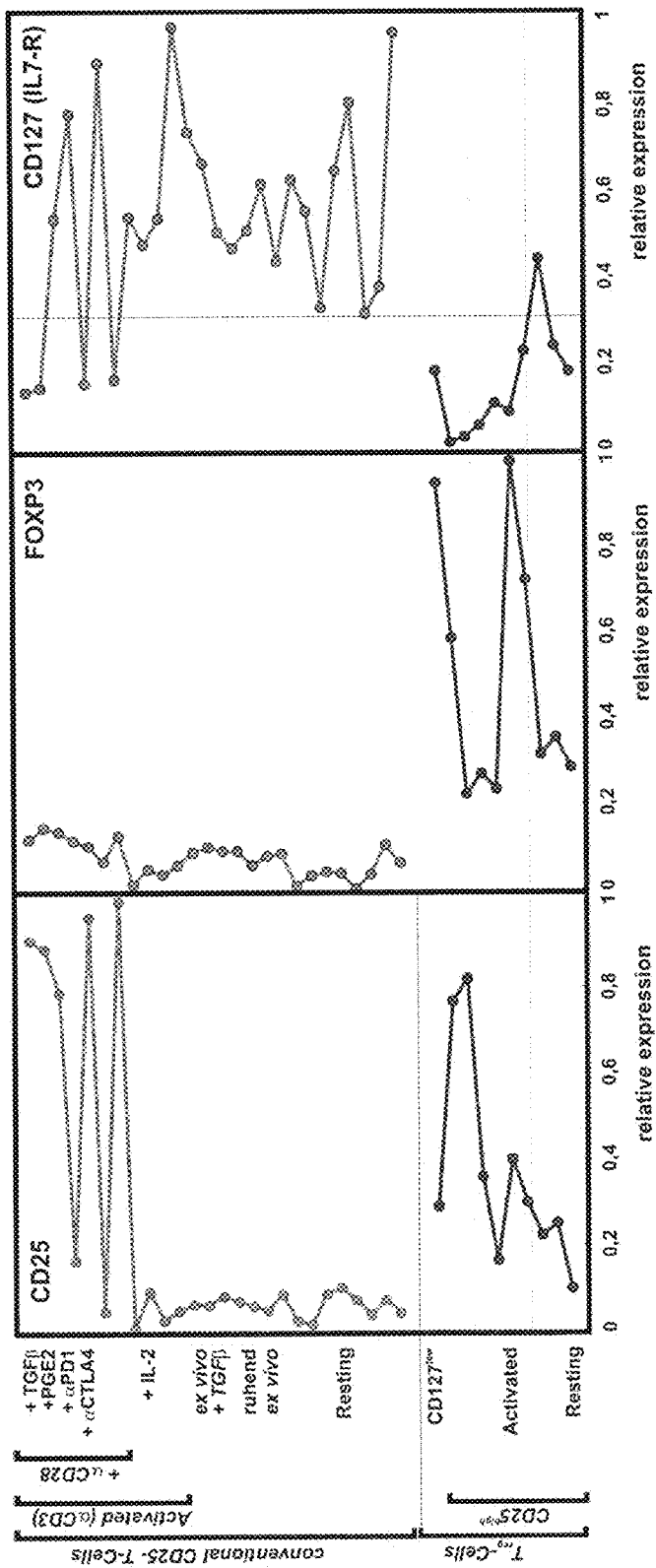
FIG. 8: Expression profiles of 3 known $T_{reg}$ cell marker genes. For screening purposes contour plots of expression profiles of selected genes were generated. Expression values were plotted over the entire dataset. Conventional T cells are shown in blue, Treg cells are shown in red. Three known marker genes for $T_{reg}$ cells are shown: CD25, FOXP3 and CD127.
Figure 9A:
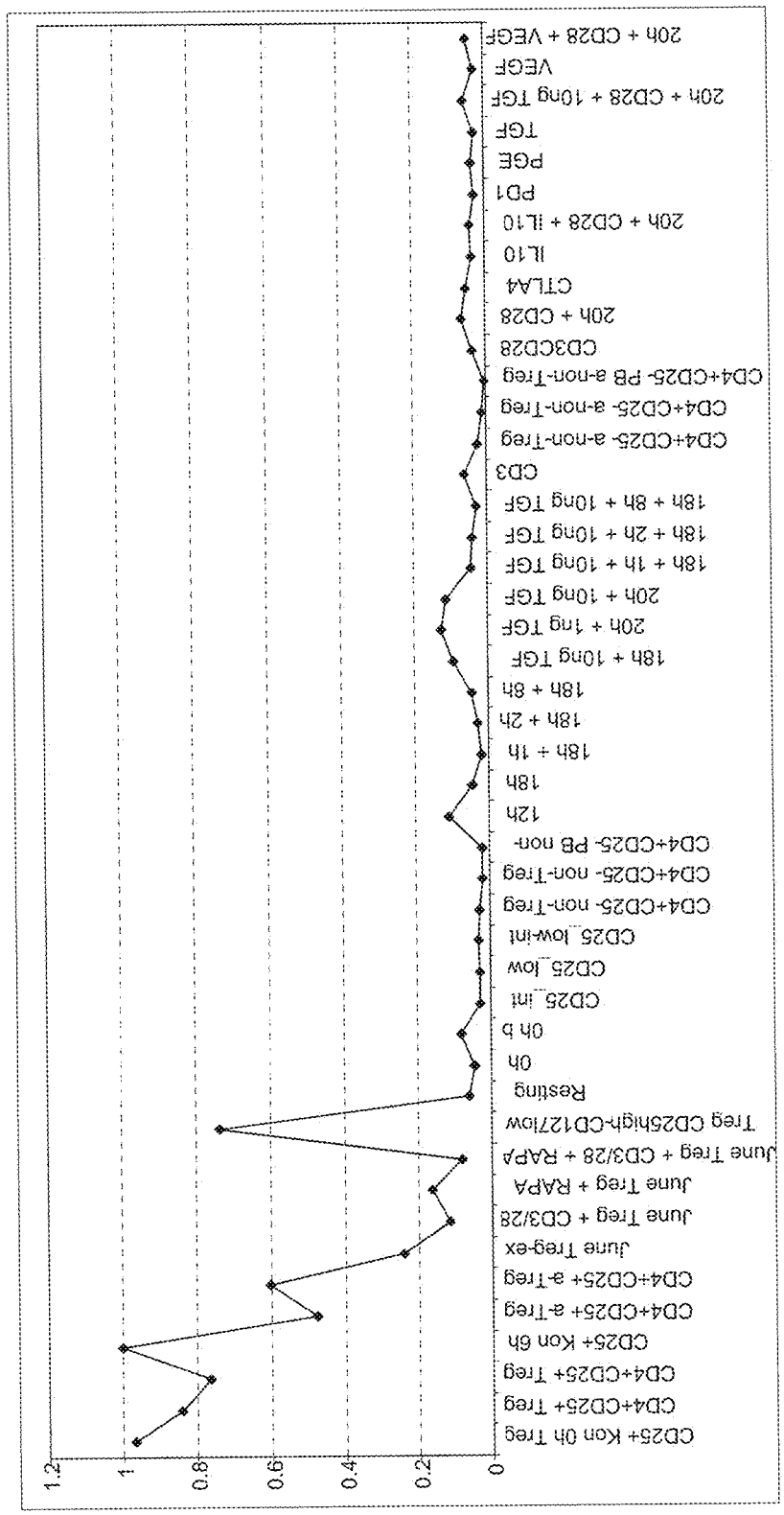
FIG. 9: Expression profile of the identified 6 $T_{reg}$ cell marker genes. The relative expression values in the given conditions are depicted. A: FANK1, B: PLEKHK1, C: HPGD, D: DNAPTP6, E: Col5, F: Col6.
Figure 9B:
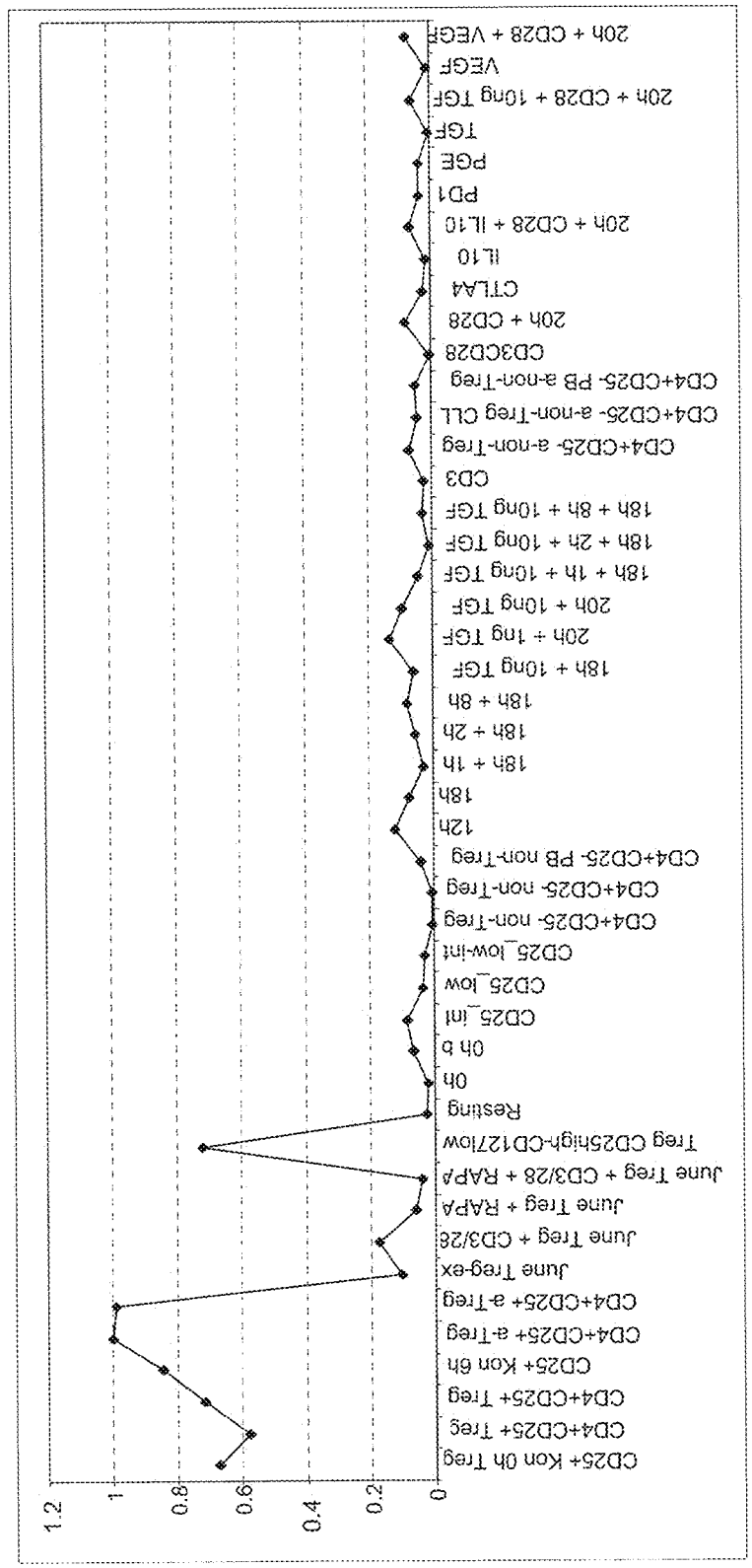
Figure 9C:
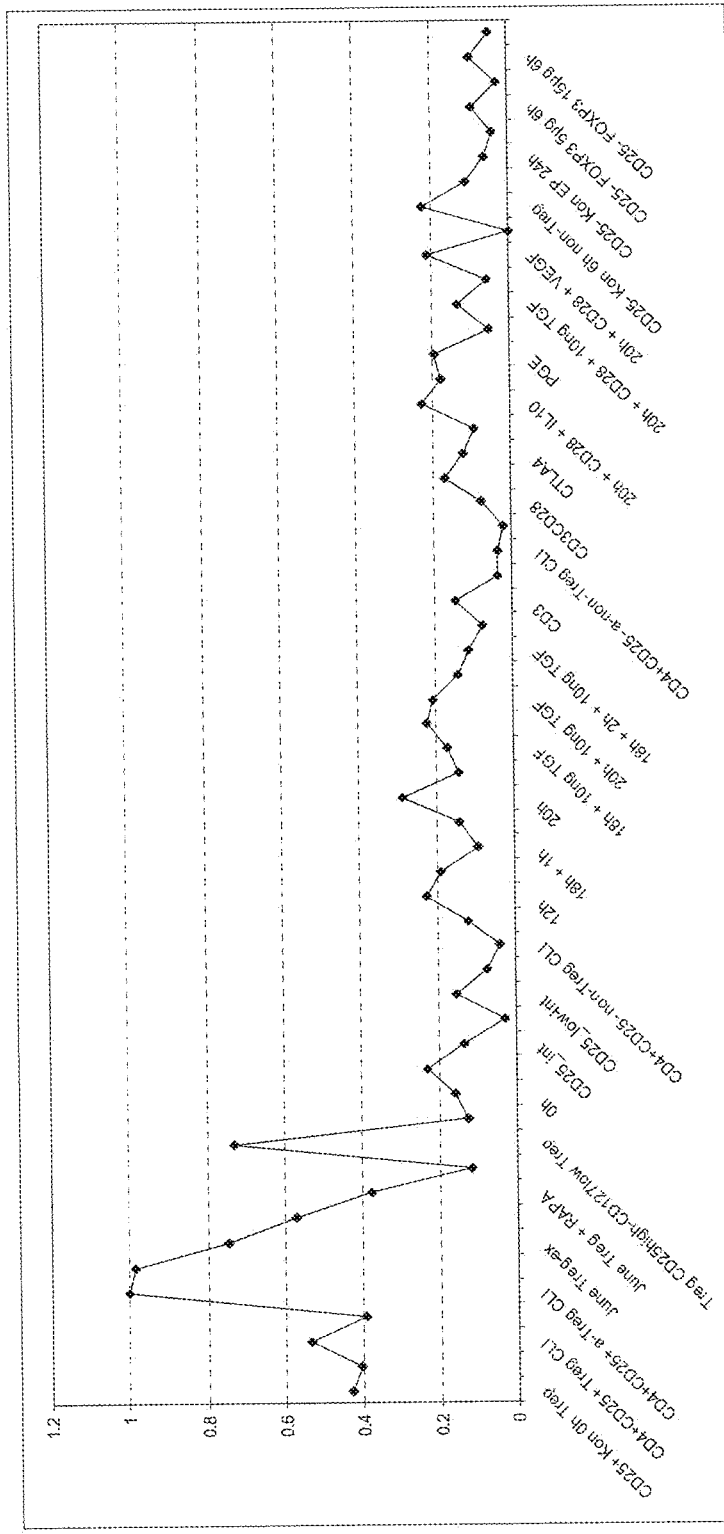
Figure 9D:
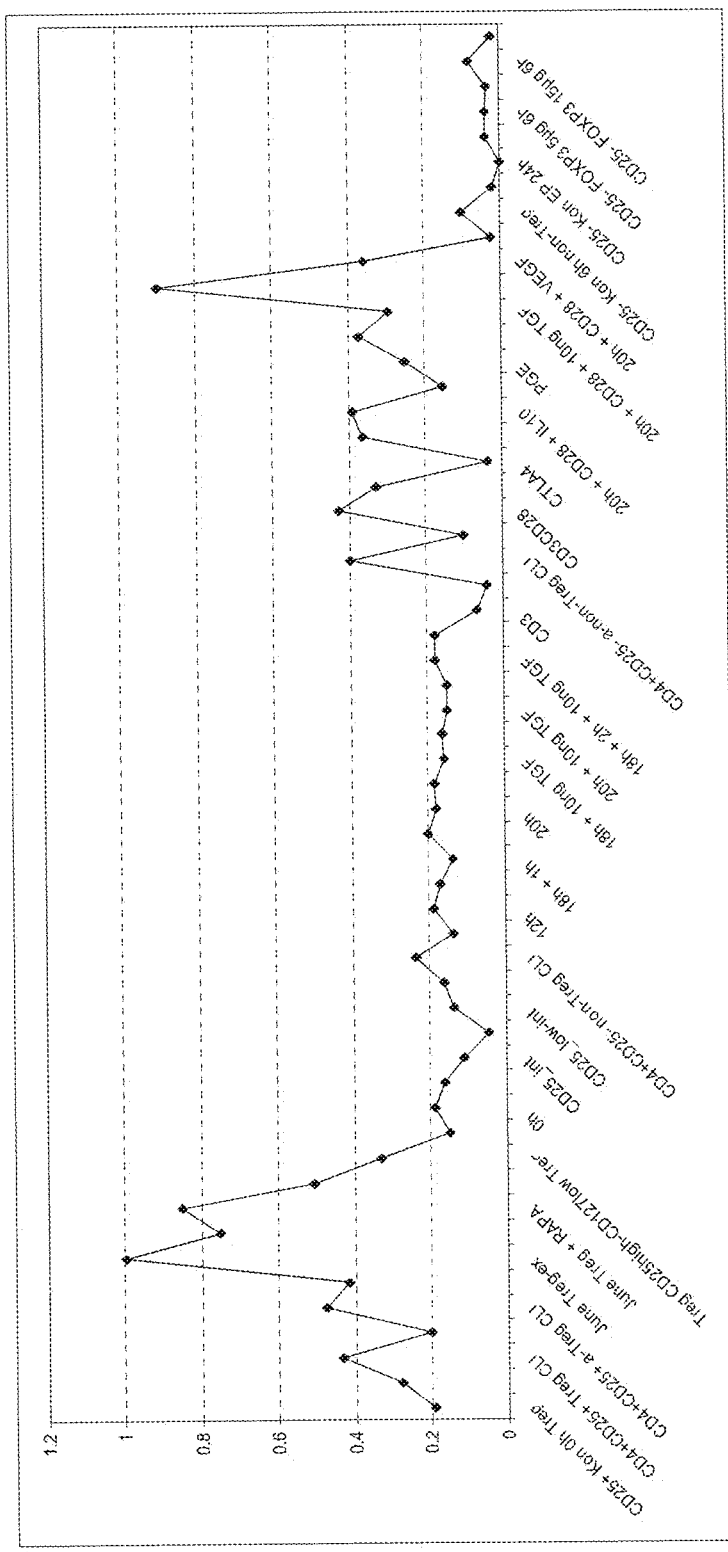
Figure 9E:
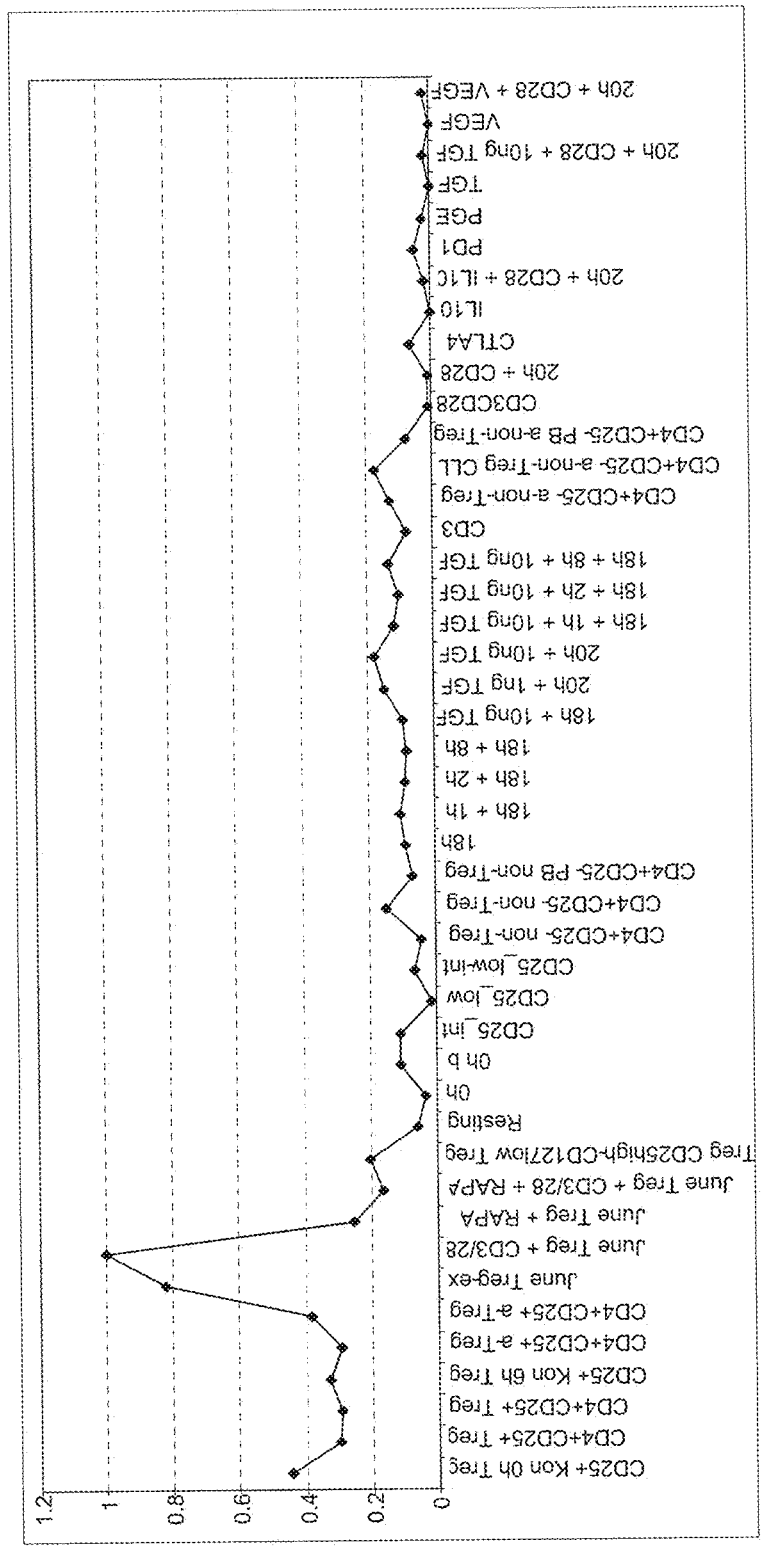
Figure 9F:
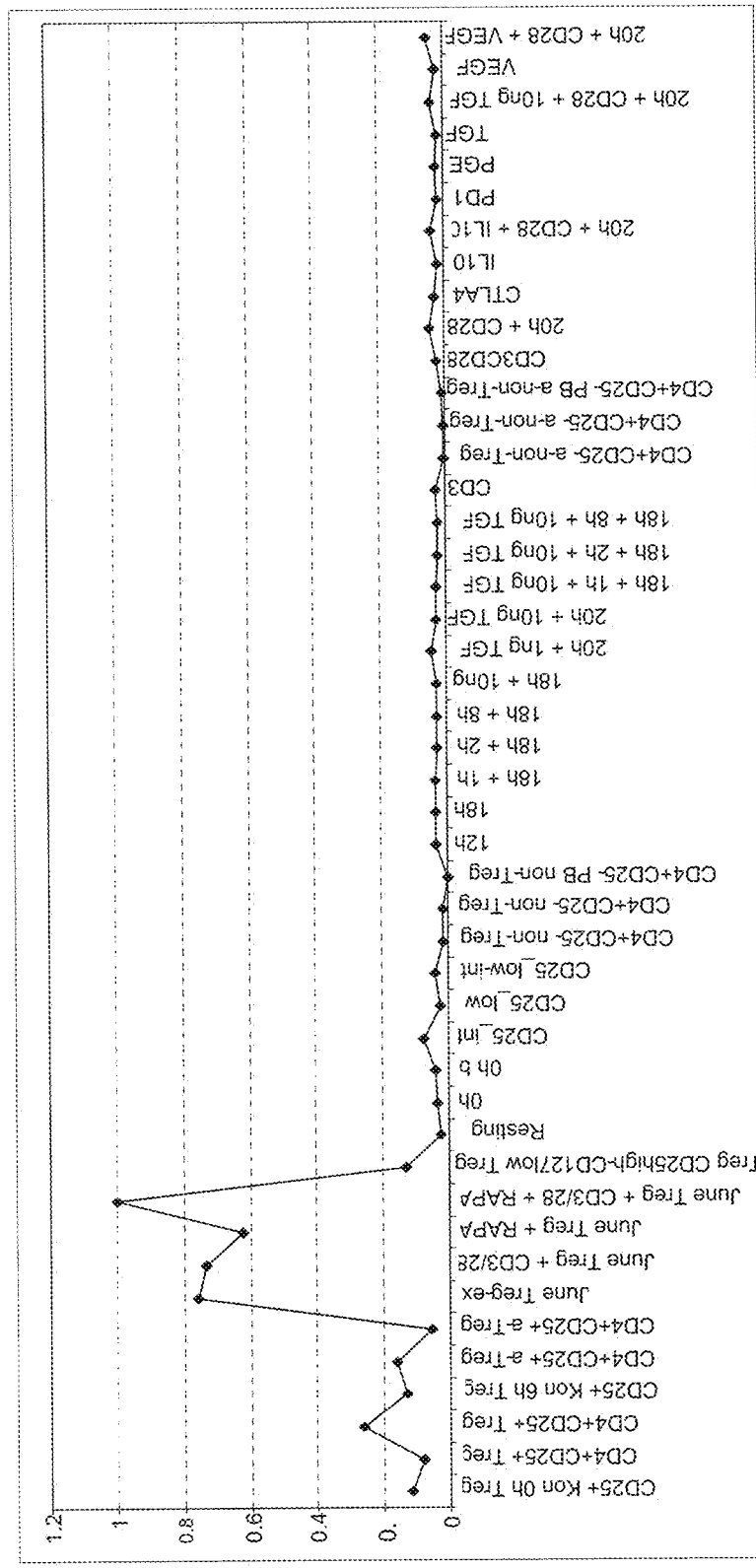
Figure 10A:
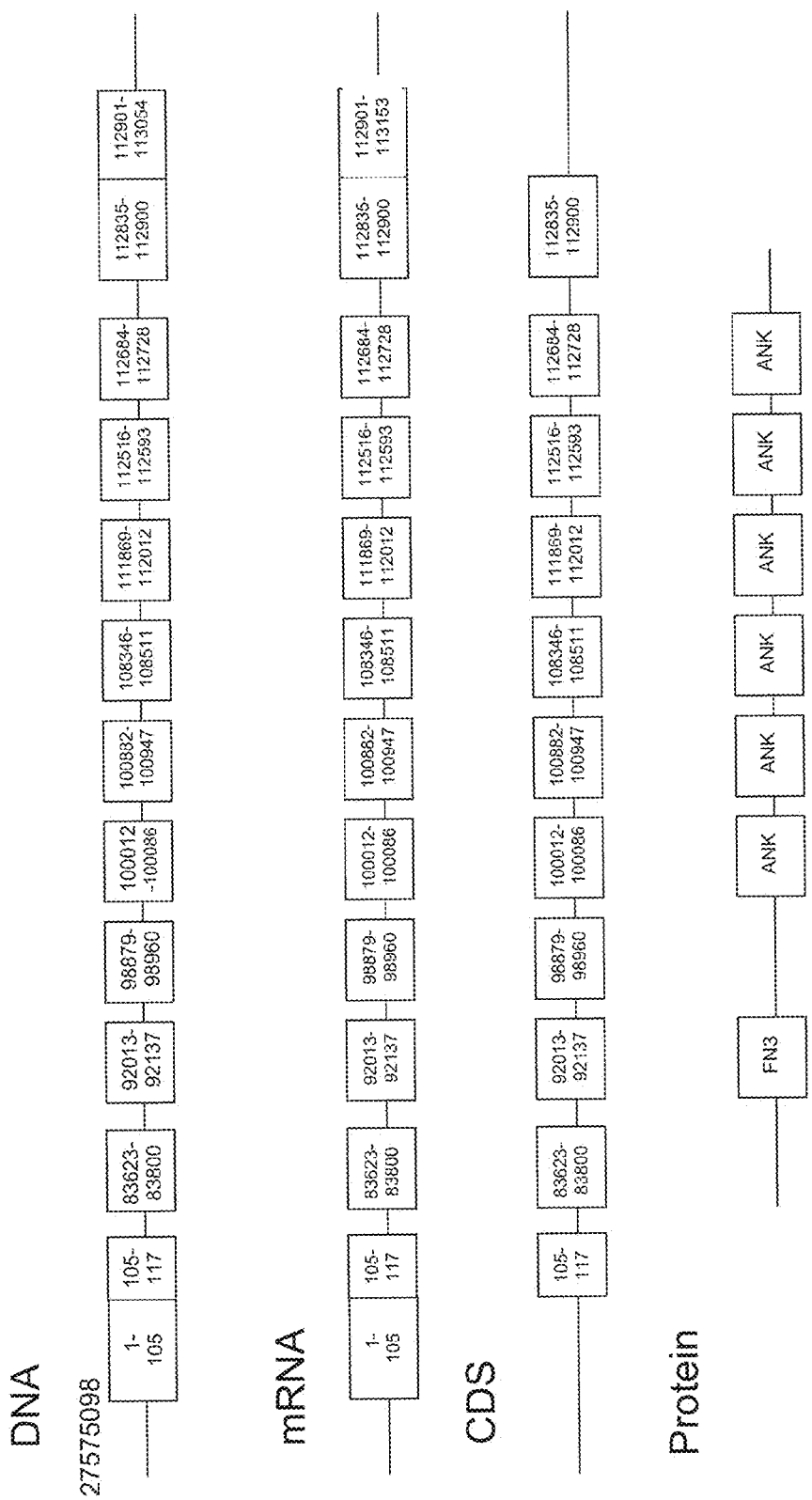
FIG. 10: Description of the 6 marker genes. The localisation of the 6 genes on the chromosome, the mRNA length, the coding sequence as well as the protein length are described in FIGS. 10A-F (A: FANK1, B: PLEKHK1, C: HPGD, D: DNAPTP6, E: Col5, F: Col6).
Figure 10B:
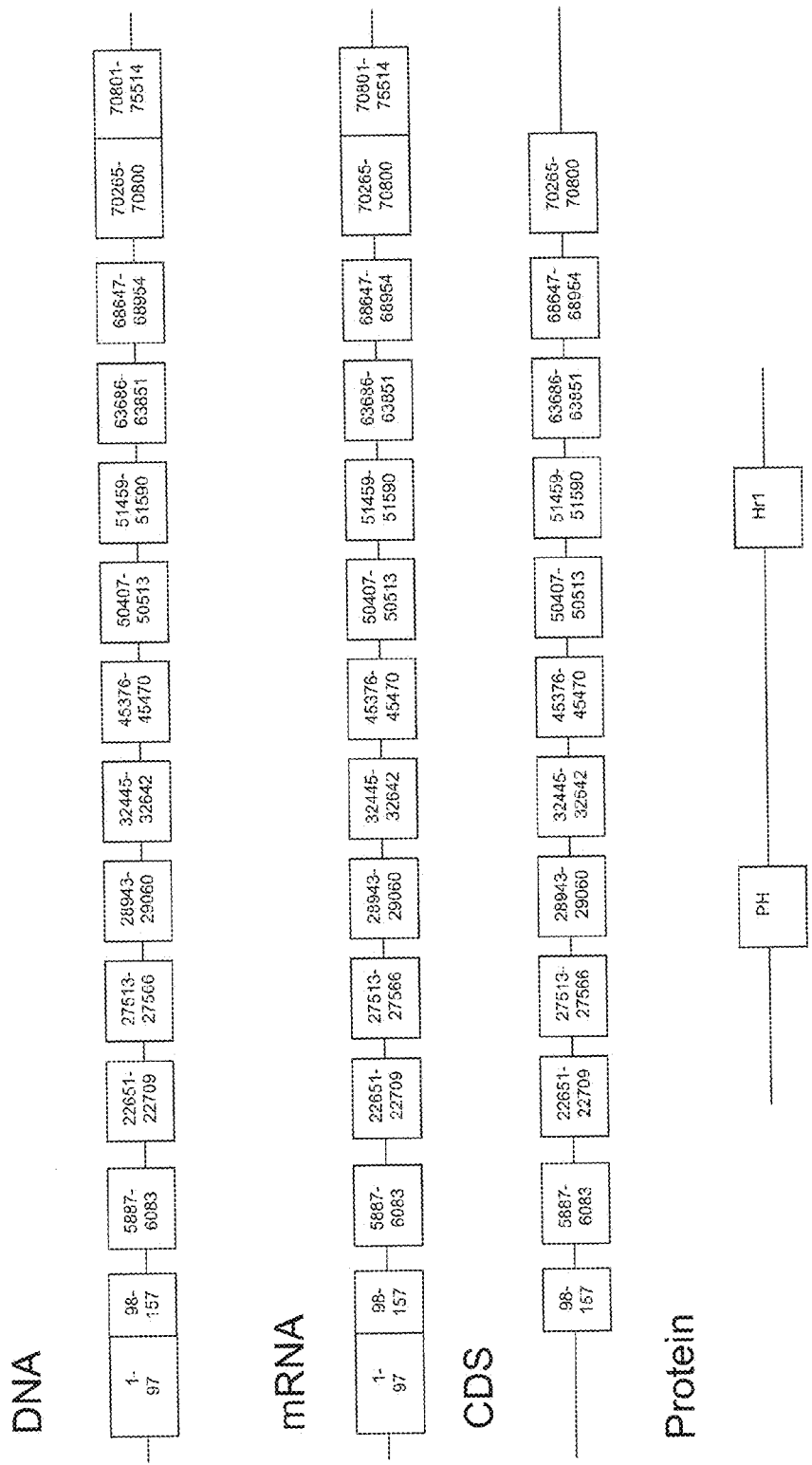
Figure 10C:
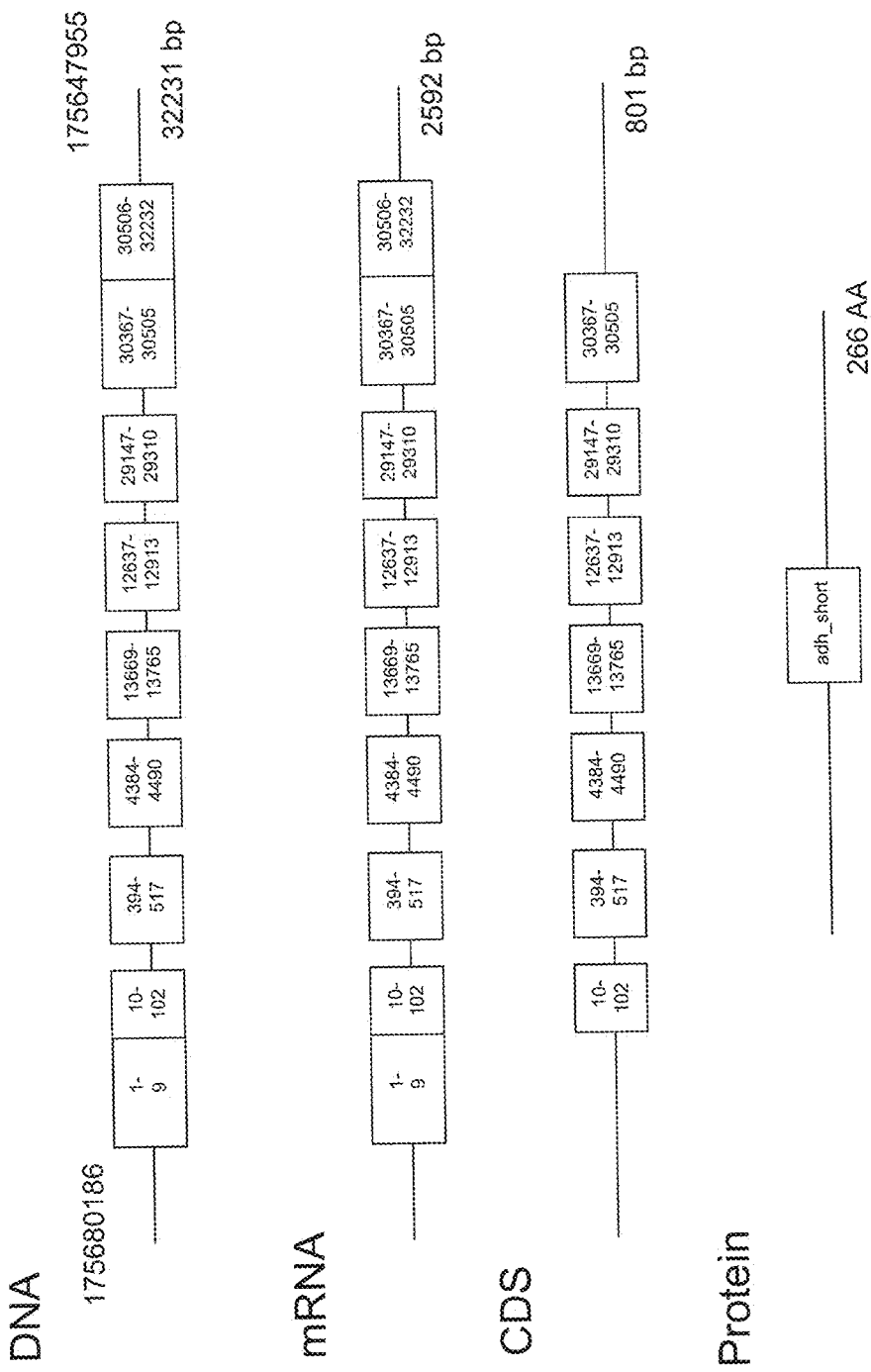
Figure 10D:
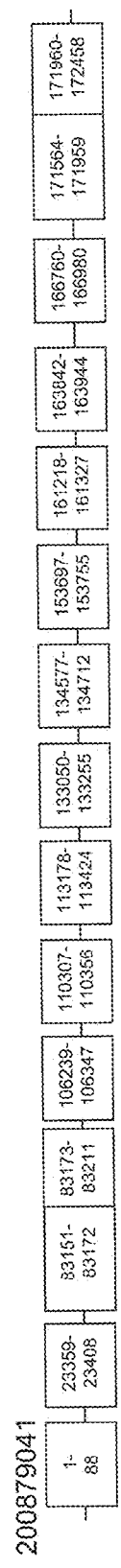
Figure 10D:
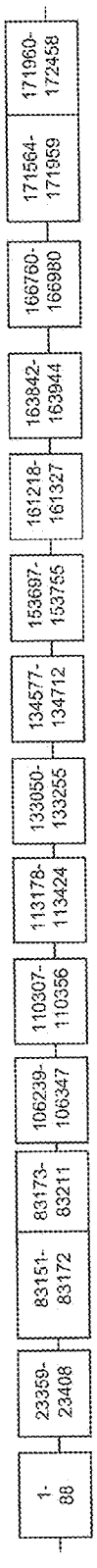
Figure 10D:
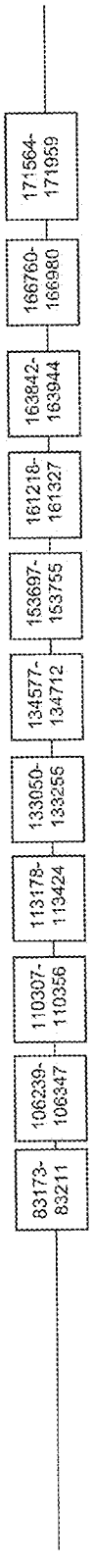
Figure 10E:
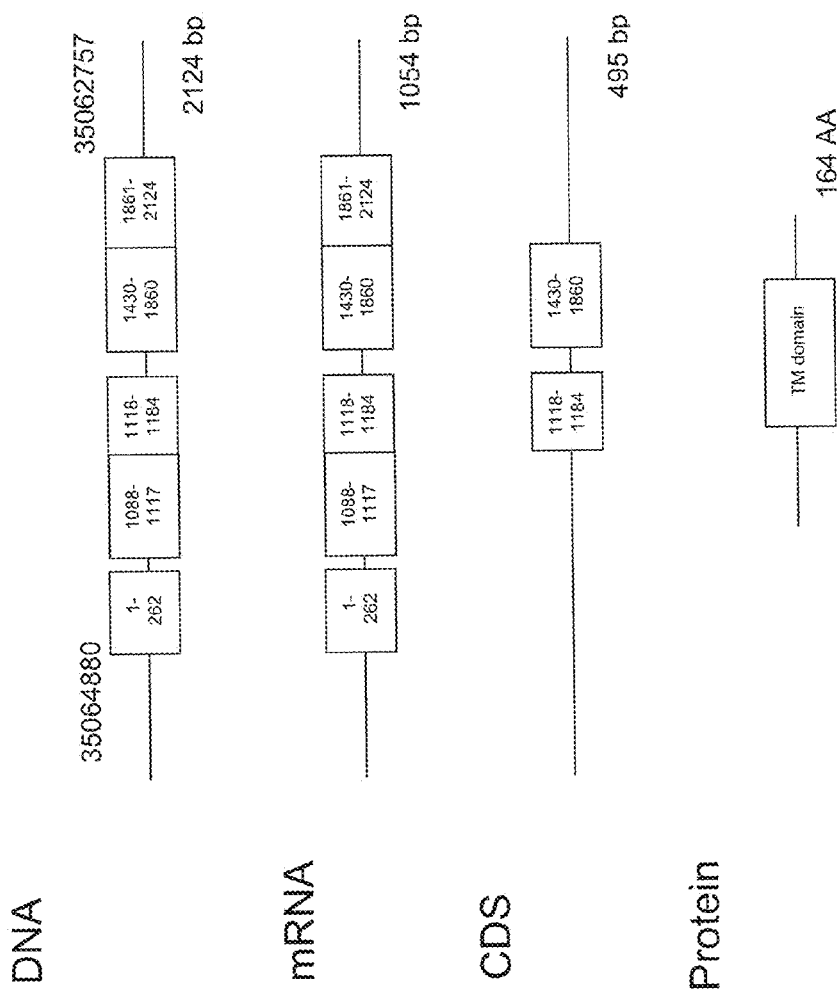
Figure 10F:
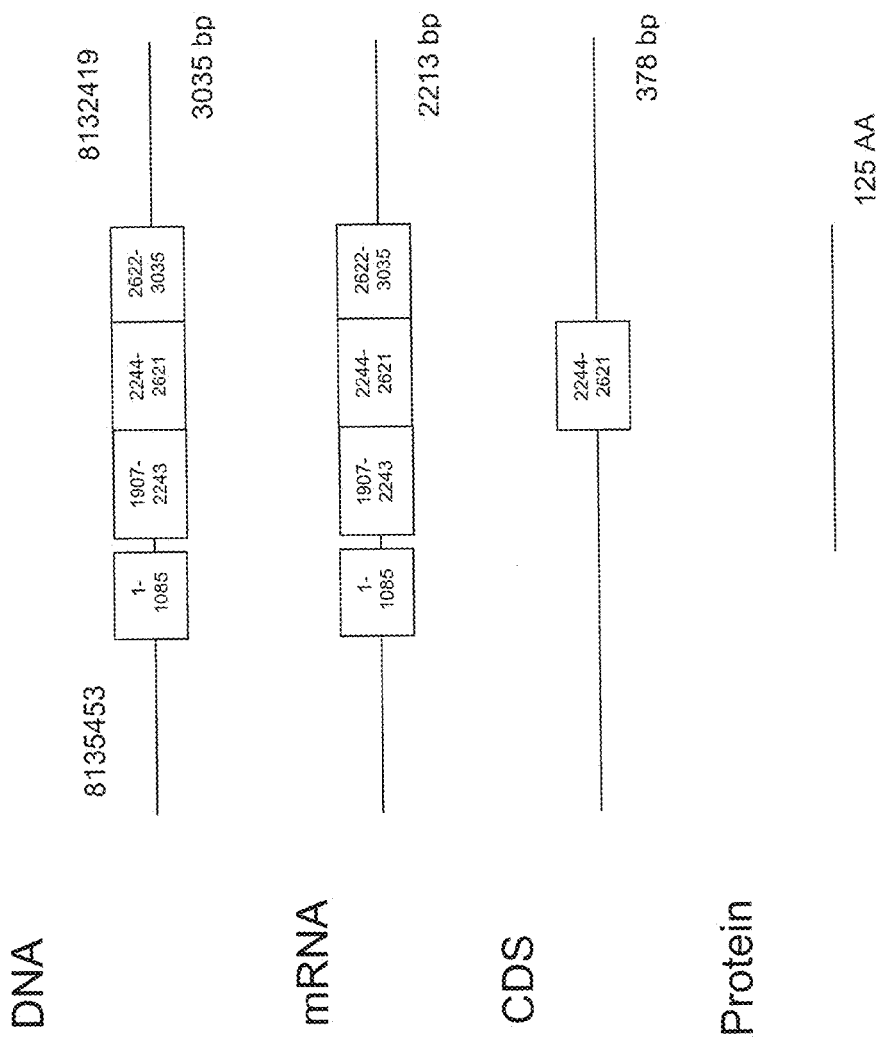

43 genes satisfied the pattern recognition criteria and were identified as the core transcriptome of $T_{reg}$ cells (Table 1). FIG. 3 visualizes these 43 genes using a three-dimensional contour-plot.

TABLE 1

43 $T_{reg}$ core genes.

| Symbol (SEQ ID NO) of mRNA | $T_{reg}$ | Resting T cells | CD25$^-$ T cells | Activated T cells |
|---|---|---|---|---|
| ACTA2 (15) | 740 +/− 75 | 414 +/− 96 | 333 +/− 106 | 528 +/− 155 |
| BFSP2 (17) | 335 +/− 125 | 155 +/− 15 | 150 +/− 31 | 143 +/− 16 |
| C1orf78 (11) | 644 +/− 108 | 327 +/− 66 | 289 +/− 68 | 295 +/− 94 |
| CCL5 (19) | 678 +/− 433 | 4998 +/− 772 | 3404 +/− 2178 | 3274 +/− 1774 |
| CCR7 (21) | 1491 +/− 561 | 4226 +/− 1310 | 3059 +/− 1012 | 3809 +/− 1320 |
| CD40LG (23) | 197 +/− 62 | 568 +/− 90 | 577 +/− 96 | 616 +/− 296 |
| CTLA4 (25, 27) | 1061 +/− 313 | 316 +/− 165 | 306 +/− 84 | 452 +/− 440 |
| CTSL (29, 31) | 100 +/− 8 | 422 +/− 259 | 202 +/− 61 | 273 +/− 121 |
| EOMES (33) | 117 +/− 25 | 352 +/− 84 | 424 +/− 335 | 337 +/− 197 |
| EPB41L3 (35) | 89 +/− 7 | 212 +/− 67 | 133 +/− 32 | 121 +/− 13 |
| FAM129A (37) | 1294 +/− 154 | 719 +/− 204 | 555 +/− 180 | 735 +/− 357 |
| FANK1 (1) | 562 +/− 118 | 116 +/− 21 | 93 +/− 2 | 98 +/− 15 |
| FCGBP (39) | 222 +/− 33 | 519 +/− 192 | 392 +/− 73 | 604 +/− 350 |
| FHIT (41) | 196 +/− 40 | 324 +/− 46 | 361 +/− 91 | 294 +/− 96 |
| FLOT1 (43) | 543 +/− 57 | 1170 +/− 213 | 1169 +/− 156 | 994 +/− 222 |
| FOXP3 (45) | 260 +/− 113 | 103 +/− 6 | 88 +/− 5 | 104 +/− 19 |
| GNLY (47, 49) | 189 +/− 45 | 3218 +/− 902 | 671 +/− 694 | 978 +/− 616 |
| HPGD (7) | 265 +/− 76 | 133 +/− 17 | 109 +/− 14 | 106 +/− 17 |
| ICA1 (51, 53) | 378 +/− 143 | 140 +/− 11 | 191 +/− 32 | 117 +/− 10 |
| IL10RA (57) | 1068 +/− 282 | 533 +/− 53 | 605 +/− 140 | 432 +/− 115 |
| IL7R (55) | 966 +/− 424 | 1852 +/− 762 | 2497 +/− 811 | 1766 +/− 1188 |
| LASS6 (61) | 145 +/− 54 | 396 +/− 39 | 373 +/− 91 | 363 +/− 94 |
| MGST2 (65) | 251 +/− 47 | 163 +/− 26 | 140 +/− 33 | 121 +/− 25 |
| PTTG3 (77) | 229 +/− 35 | 128 +/− 16 | 143 +/− 23 | 134 +/− 36 |
| KIAA1600 (59) | 782 +/− 148 | 544 +/− 70 | 452 +/− 56 | 445 +/− 67 |
| C6orf190 (735) | 186 +/− 57 | 425 +/− 90 | 514 +/− 66 | 416 +/− 162 |
| LOC339541 (63) | 205 +/− 55 | 422 +/− 66 | 508 +/− 133 | 398 +/− 110 |
| TARP (103, 105) | 191 +/− 54 | 640 +/− 94 | 638 +/− 393 | 450 +/− 225 |
| RBMS1 (81, 83, 85) | 354 +/− 34 | 723 +/− 225 | 744 +/− 77 | 545 +/− 65 |
| NCF4 (67, 69) | 1184 +/− 285 | 640 +/− 110 | 433 +/− 135 | 344 +/− 1067 |
| NELL2 (71) | 251 +/− 148 | 1707 +/− 560 | 877 +/− 152 | 1164 +/− 565 |
| PLEKHK1 (3, 5) | 653 +/− 109 | 166 +/− 31 | 142 +/− 19 | 151 +/− 18 |
| PTPLA (73) | 317 +/− 64 | 136 +/− 17 | 123 +/− 6 | 115 +/− 25 |
| PTTG1 (75) | 299 +/− 89 | 172 +/− 29 | 173 +/− 25 | 147 +/− 39 |
| RAB6IP1 (79) | 127 +/− 21 | 280 +/− 46 | 306 +/− 63 | 238.83 +/− 54 |
| RHOU (87) | 107 +/− 6 | 178 +/− 28 | 217 +/− 61 | 146 +/− 28 |
| SATB1 (89) | 787 +/− 112 | 1988 +/− 262 | 1739 +/− 439 | 2028 +/− 687 |
| SELP (91) | 461 +/− 169 | 146 +/− 9 | 144 +/− 24 | 149 +/− 21 |
| SEMA3G (93) | 194 +/− 64 | 105 +/− 6 | 109 +/− 10 | 105 +/− 3 |
| SHMT2 (95) | 1741 +/− 310 | 797 +/− 126 | 724 +/− 187 | 1275 +/− 812 |
| STAM (97) | 637 +/− 194 | 264 +/− 25 | 207 +/− 35 | 217 +/− 30 |
| STOM (99, 101) | 345 +/− 54 | 783 +/− 60 | 920 +/− 278 | 692 +/− 258 |
| TCF7 (107, 109, 111, 113) | 8270 +/− 3071 | 16713 +/− 1197 | 17162 +/− 3138 | 11895 +/− 5380 |
| TNFRSF1B (115) | 1950 +/− 360 | 861 +/− 145 | 832 +/− 216 | 826 +/− 265 |
| TRIM16 (117) | 433 +/− 125 | 253 +/− 18 | 286 +/− 32 | 247 +/− 24 |
| UTS2 (119, 121) | 263 +/− 84 | 162 +/− 28 | 149 +/− 21 | 130 +/− 4 |

Displayed are mean expression values +/− standard deviation for the distinct sample groups

Example 2

Analysis of 6 Potential Treg Marker Genes

A. FANK1:

Human FANK1 (FANK1 fibronectin type III and ankyrin repeat domains 1; Cologne 1) is located in the 127575098-127688151 genomic region on chromosome 10 in the 10q26.2 region. It consists of 11 exons resulting after transcription in an mRNA which has 1395 base pairs (see SEQ ID NO:1). The actual coding sequence itself consists of 1038 base pairs. The translation of this sequence results in a putative protein with a length of 346 amino acids (SEQ ID NO:2).

B. PLEKHK1:

Human PLEKHK1 (pleckstrin homology domain containing, family K member 1, also known as rhotekin-2; Cologne 2) is located in the 63698472-63622959 genomic region on chromosome 10 in the 10q21.2 region. It consists of 12 exons resulting after transcription in an mRNA which has 6659 base pairs (see SEQ ID NO:3, A further variant thereof having 2123 base pairs being shown in SEQ ID NO:5). The actual coding sequence itself consists of 1830 base pairs.

The translation of this sequence results in a putative protein with a length of 609 amino acids (SEQ ID NO:4).

C. HPGD:

Human HPGD (Hydroxyprostaglandin dehydrogenase 15-(NAD); Cologne 3) is located in the 175680186-175647955 genomic region on chromosome 4 in the 4q34-35 region. It consists of 7 exons resulting after transcription in an mRNA which has 2592 base pairs. The actual coding sequence itself consists of 801 base pairs (see SEQ ID NO:7). The translation of this sequence results in a putative protein with a length of 266 amino acids (see SEQ ID NO:8).

D. DNAPTP6:

Human DNAPTP6 (DNA polymerase-transactivated protein 6; Cologne 4) is located in the 200879041-201051498 genomic region on chromosome 2 in the 2q33.1 region. It consists of 13 exons resulting after transcription in an mRNA which has 2355 base pairs (see SEQ ID NO:9). The actual coding sequence itself consists of 1677 base pairs. The translation of this sequence results in a putative protein with a length of 558 amino acids.

E. C1orf78:

Human C1orf78 (chromosome 1 open reading frame 78; Cologne 5) is located in the 36562342-36560219 genomic region on chromosome 1 in the 1p34.3 region. It consists of 3 exons resulting after transcription in an mRNA which has 1054 base pairs. The actual coding sequence itself consists of 495 base pairs (see SEQ ID NO:11). The translation of this sequence results in a putative protein with a length of 164 amino acids (SEQ ID NO:12).

F. FLJ45983:

Human FLJ45983 (FLJ45983 protein; Cologne 6) is located in the 8135453-8132419 genomic region on chromosome 10 in the 10p14 region. It consists of 2 exons resulting after transcription in an mRNA which has 2213 base pairs. The actual coding sequence itself consists of 378 base pairs (see SEQ ID NO:13). The translation of this sequence results in a putative protein with a length of 125 amino acids (SEQ ID NO:14).

Example 3

Cloning of the 6 Candidate Genes into Bacterial and Mammalian Expression Vectors A. cDNA Amplification:

Full Length cDNA clones for all 6 candidate genes were ordered from the RZPD (Deutsches Ressourcenzentrum für Genomforschung GmbH, Heubnerweg 6, D-14059 Berlin, Germany). First of all clones were plated on agar plates to select one single clone, that was then grown in over night cultures to amplify the vector. DNA was isolated using the QIAquick Gel Extraction Kit from Qiagen. Using specific primers the cDNA was amplified for further cloning.

TABLE 2 primers for cloning of Col1-6

| Gene | Primer | SEQ ID NO | Sequence | Product size (bp) |
|---|---|---|---|---|
| Col1 | FANK1 PCR fw | 123 | ATGGAGCCCCAGAGAATCAT | |
| | FANK1 PCR rv | 124 | GCAGACACAAGACTTCTTTGG | 1035 |
| | FANK1 PCR rv stop | 125 | TCAGCAGACACAAGACTTCTT | 1038 |
| Col2 | PLEKHK1 PCR fw | 126 | ATGGAGGGGCCGAGCCT | |
| | PLEKHK1 PCR rv | 127 | TACTTGTGCCTGCAGCCAT | 1827 |
| | PLEKHK1 PCR rv stop | 128 | CTATACTTGTGCCTGCAGCC | 1830 |
| Col3 | HPGD PCR fw | 129 | ATGCACGTGAACGGCAAAGT | |
| | HPGD PCR rv | 130 | TTGGGTTTTTGCTTGAAATGGA | 798 |
| | HPGD PCR rv stop | 131 | TCATTGGGTTTTTGCTTGAAATG | 801 |
| Col4 | DNAPTP6 PCR fw | 132 | ATGGCTGAACTCAATACTCATG | |
| | DNAPTP6 PCR rv | 133 | GGCCACCAACGTCACAGCCG | 1674 |
| | DNAPTP6 PCR rv stop | 134 | TCAGGCCACCAACGTCACAG | 1677 |
| Col5 | Col5 PCR fw | 135 | ATGGATGCCCCGCGAAGGGA | |
| | Col5 PCR rv | 136 | GTAATAGTGCATGCGGCCCAGG | 495 |
| | Col5 PCR rv stop | 137 | TCAGTAATAGTGCATGCGGC | 498 |
| Col6 | Col6 PCR fw | 138 | ATGGAGCCGGACTTTCTCC | |
| | Col6 PCR rv | 139 | GGACTTCGACCCCGGGGCTC | 375 |
| | Col6 PCR rv stop | 140 | TCAGGACTTCGACCCCGGG | 378 |

For cloning into the bacterial expression vector pTrcHis-TOPO (Invitrogen) cDNA was amplified with stop-codon whereas the cDNA was amplified without stop-codon for cloning into the Lentiviral expression vector pLenti6/V5-Dest (Invitrogen).

Figure 11A:
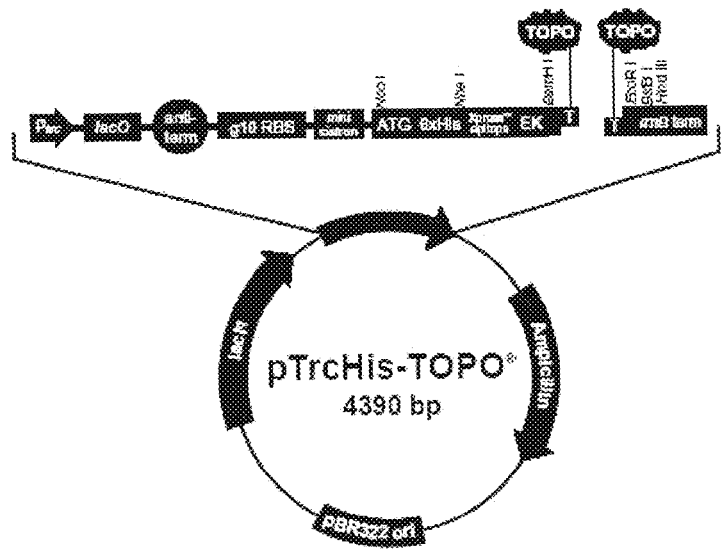
In FIG. 11A a map of the empty pTrcHis-TOPO vector is shown. This vector (4390 bp) contains a trc promotor, an initiation ATG, a 6×His tag and an Xpress epitope and an ampicillin resistance gene. Therefore, all proteins cloned into this vector are at the N-terminal His- and Xpress-tagged.
Figure 11B:
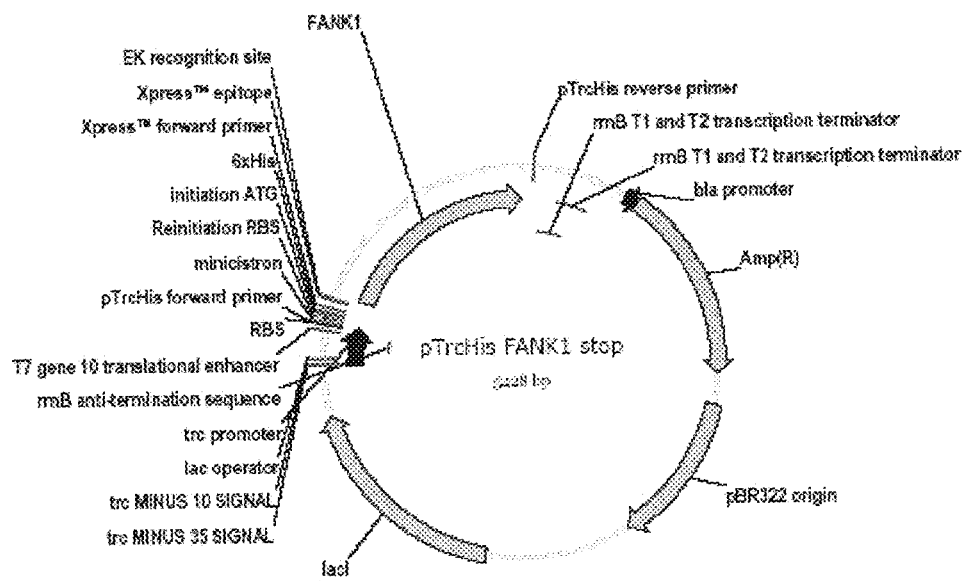
FIGS. 11B-G depict the vector including the cDNA sequences including the stop-codon of the 6 genes (B: FANK1, C: PLEKHK1, D: HPGD, E: DNAPTP6, F: Col5, G: Col6; the exact sequences of 11B-G are given in SEQ ID NOs:141-146).
Figure 11C:
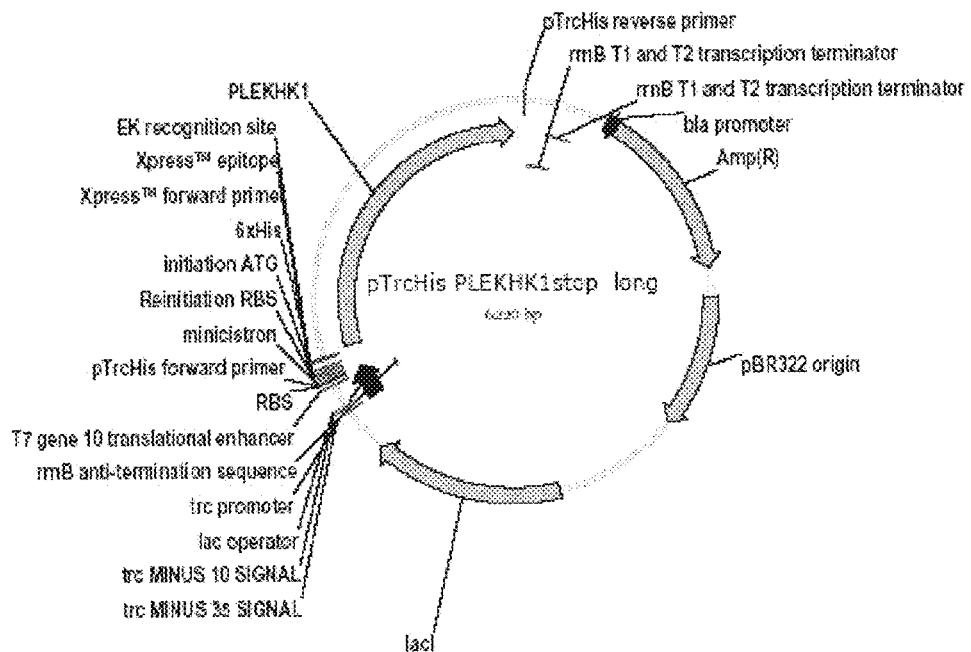
Figure 11D:
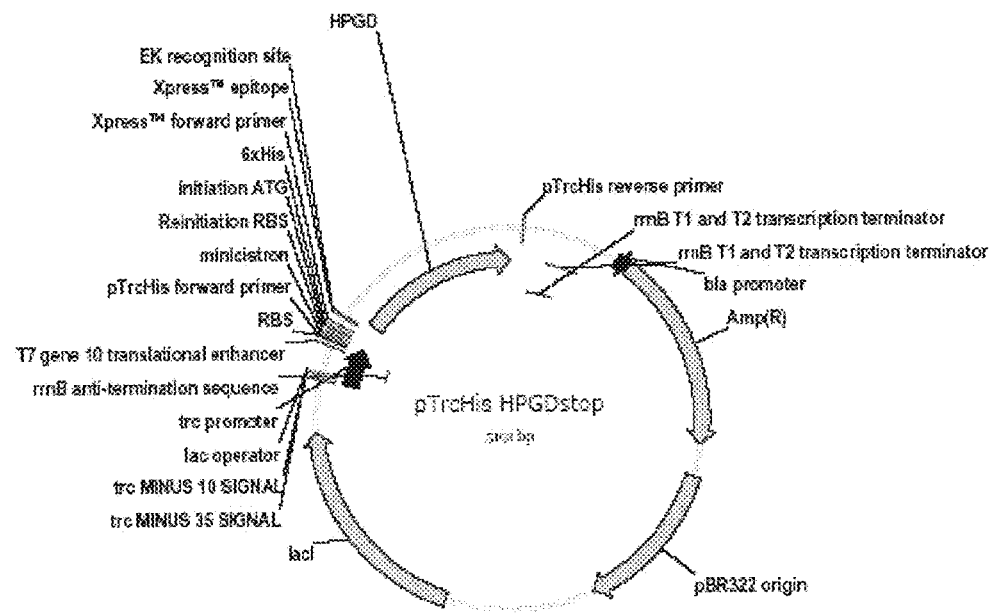
Figure 11E:
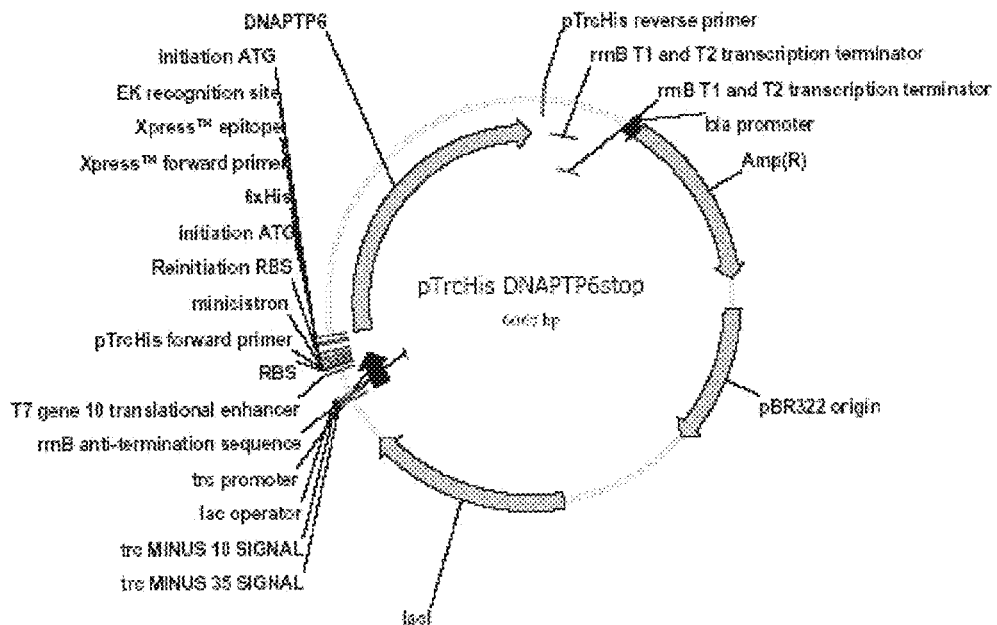
Figure 11F:
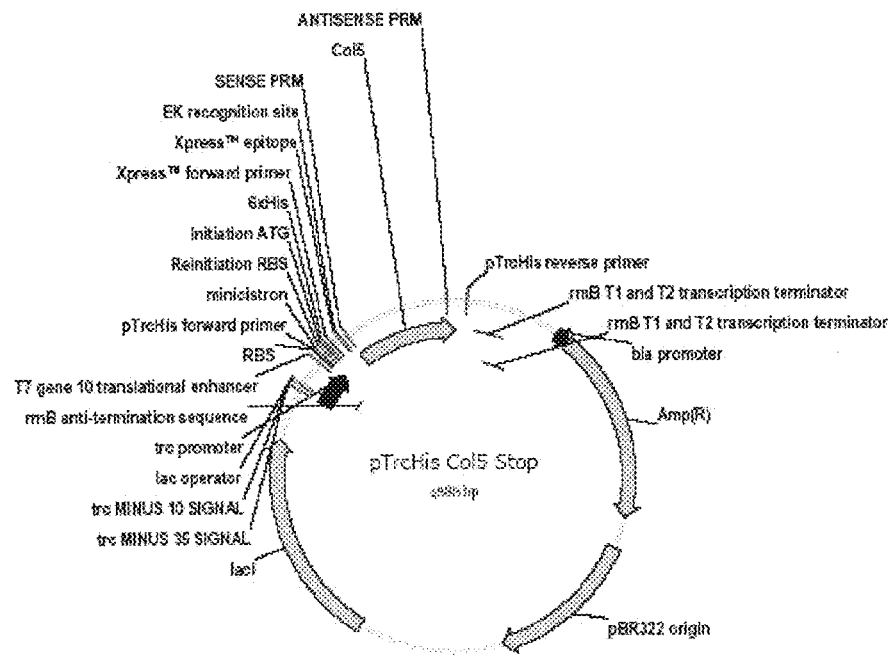
Figure 11G:
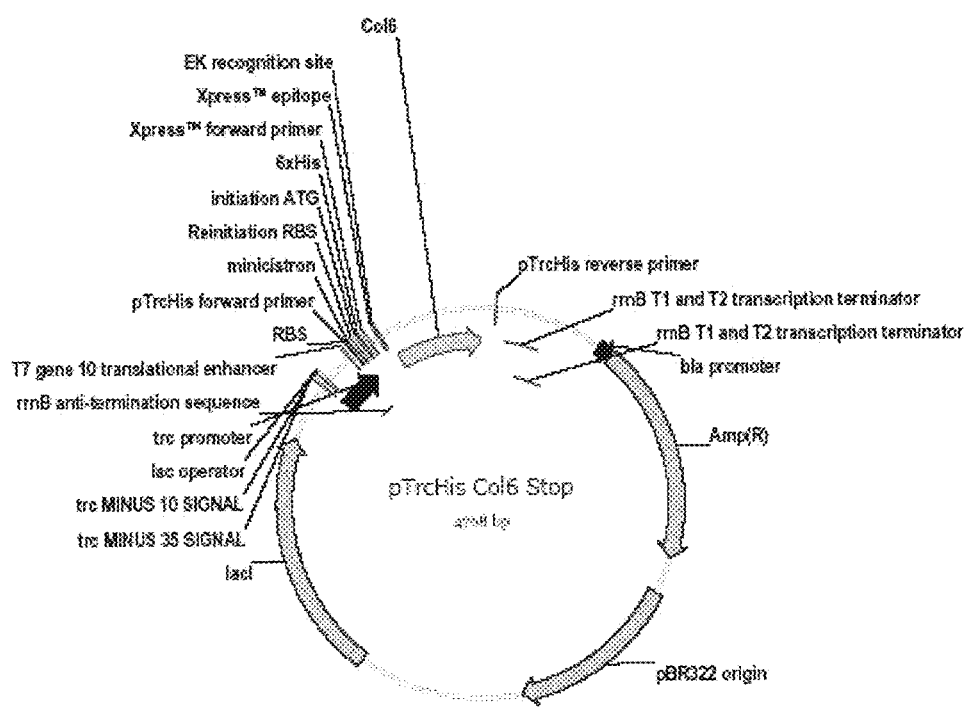
Figure 12A:
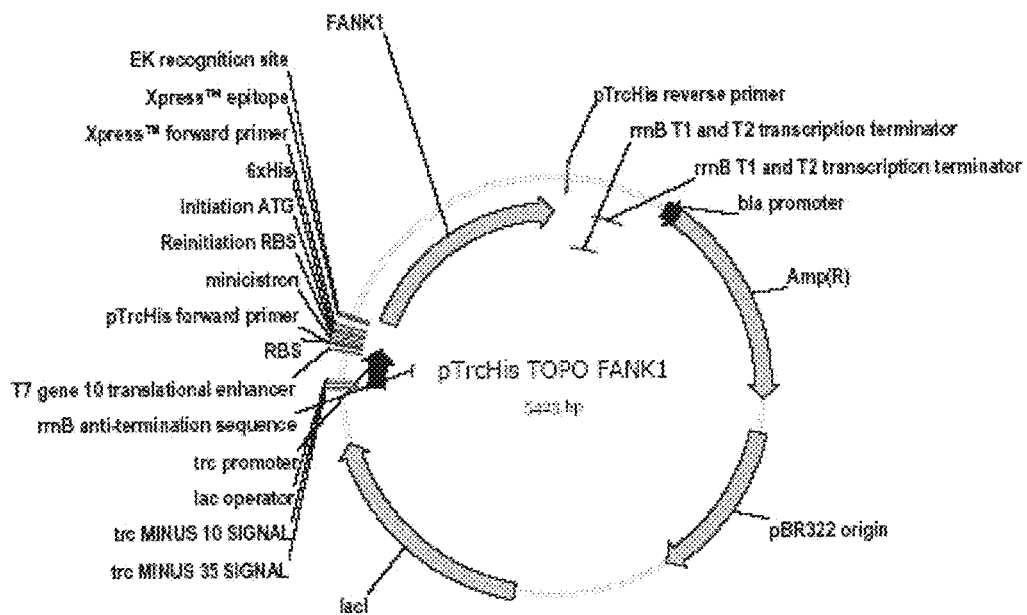
FIGS. 12A-F depict the pTrcHis-TOPO vector with the cDNA sequences excluding the stop-codon of the 6 genes (A: FANK1, B: PLEKHK1, C: HPGD, D: DNAPTP6, E: Col5, F: Col6). These vectors are suitable for cloning the cDNA without stop-codon into different mammalian expression vectors.
Figure 12B:
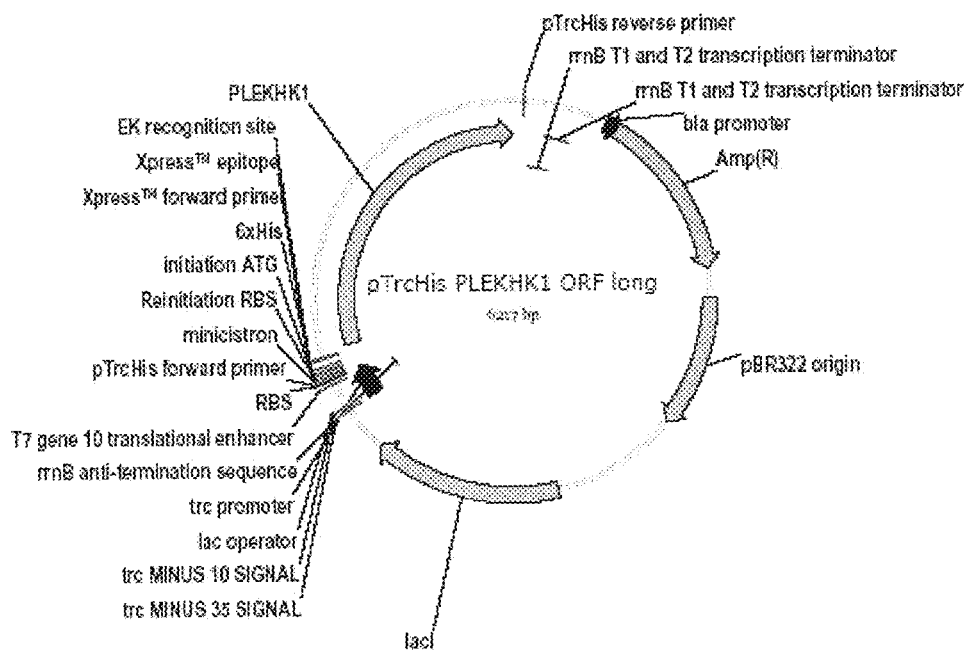
Figure 12C:
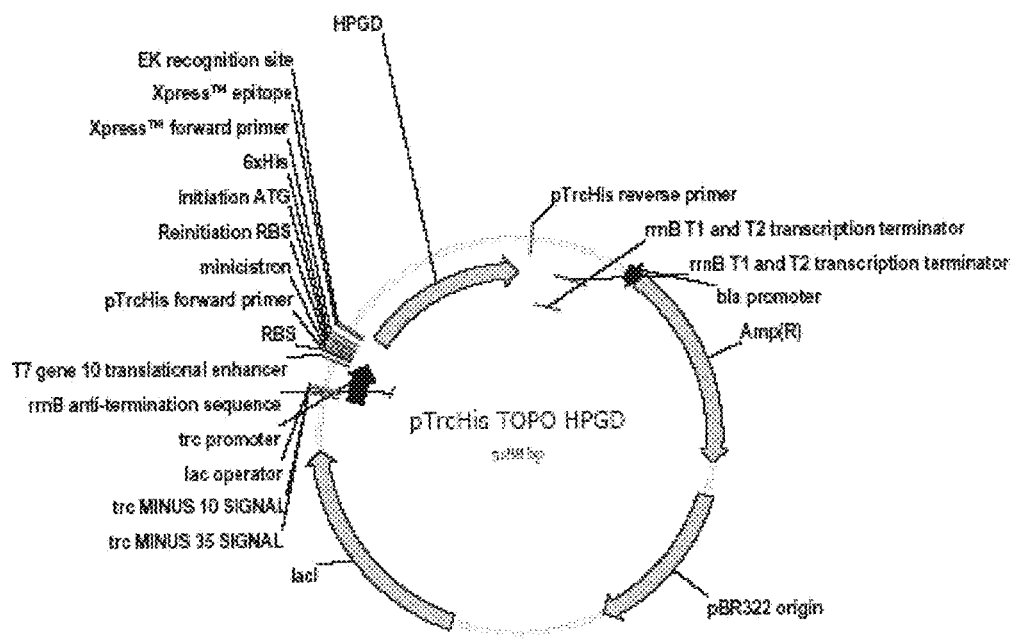
Figure 12D:
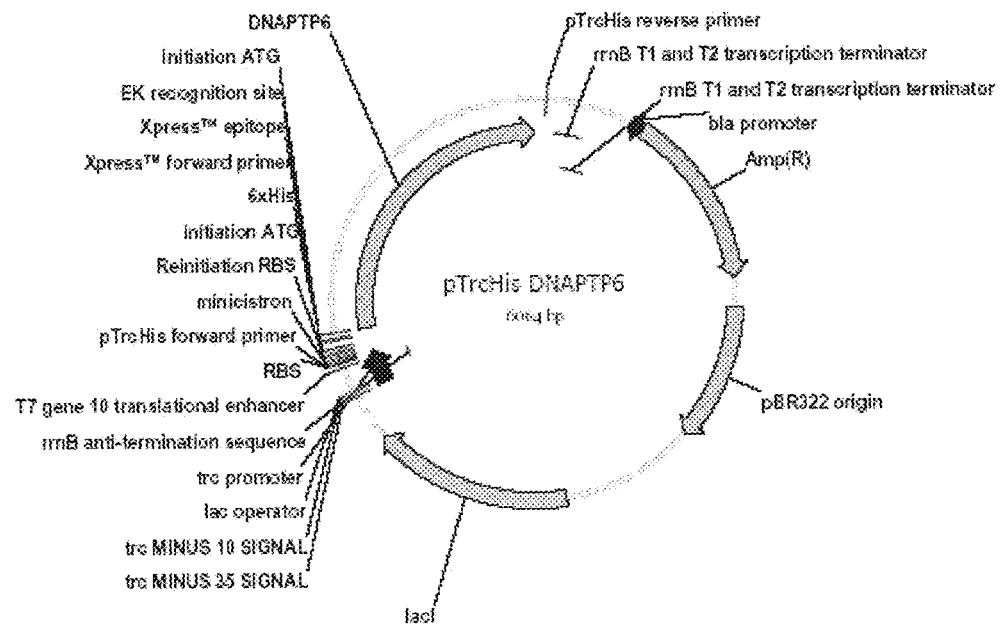
Figure 12E:
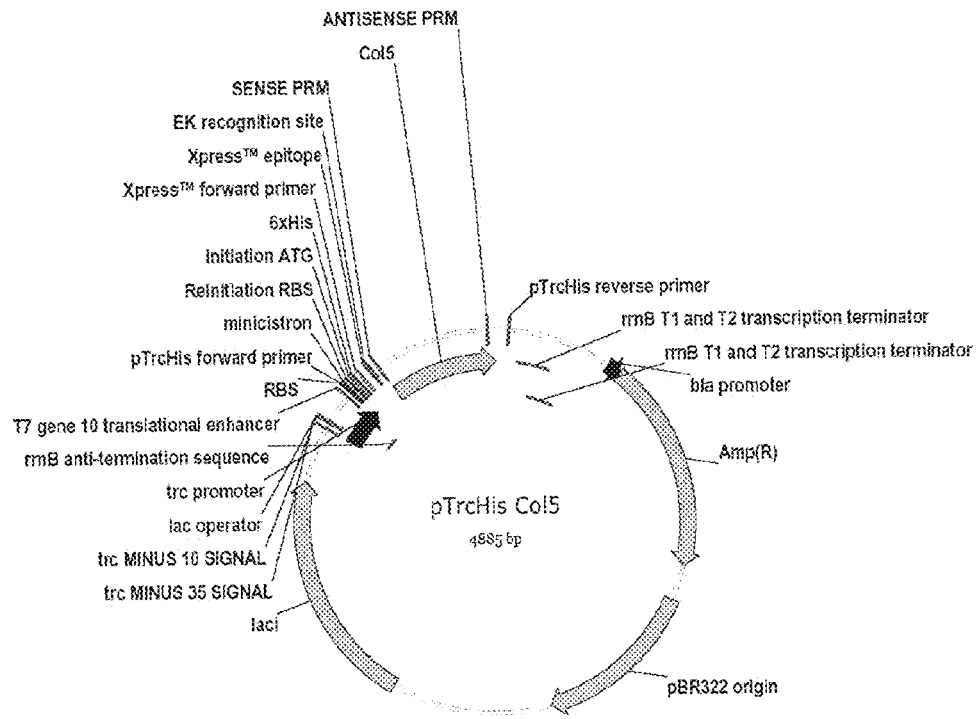
Figure 12F:
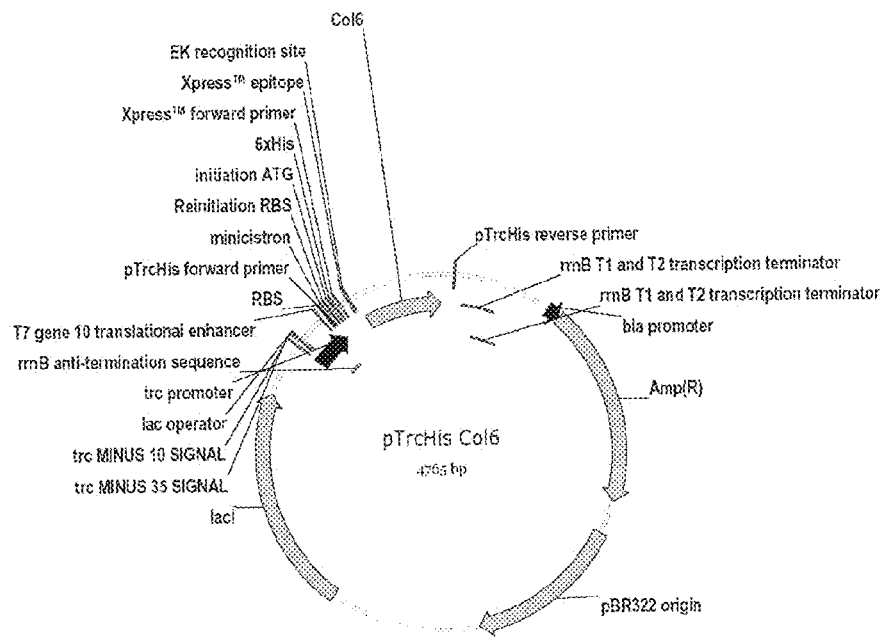
Figure 13A:
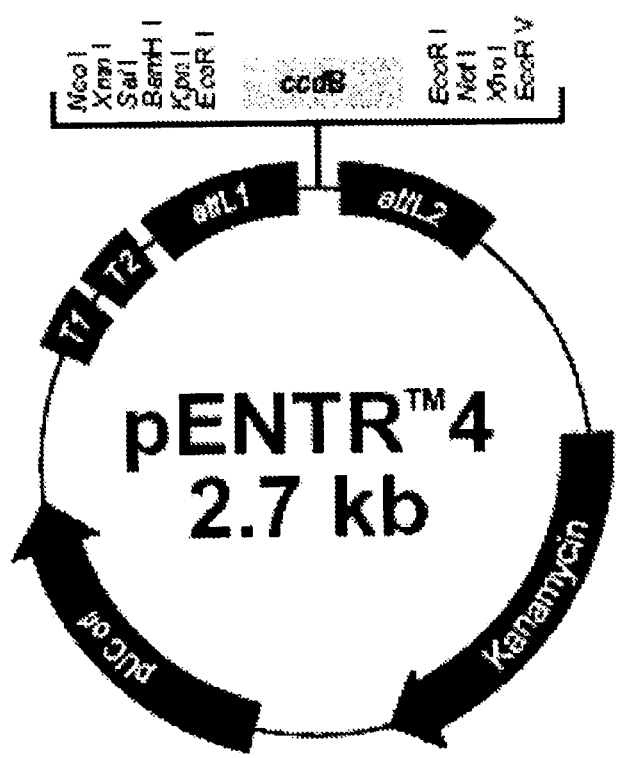
In FIG. 13A a map of the pENTR4 vector modified with an eGFP molecule is shown. This vector (3441 bp) contains a pUC origin, a eGFP-tag, an kanamycin resistance gene and two attL sites for site specific recombination into destination vectors. Therefore, all proteins cloned into this vector are at the C-terminal eGFP-tagged.
Figure 13B:
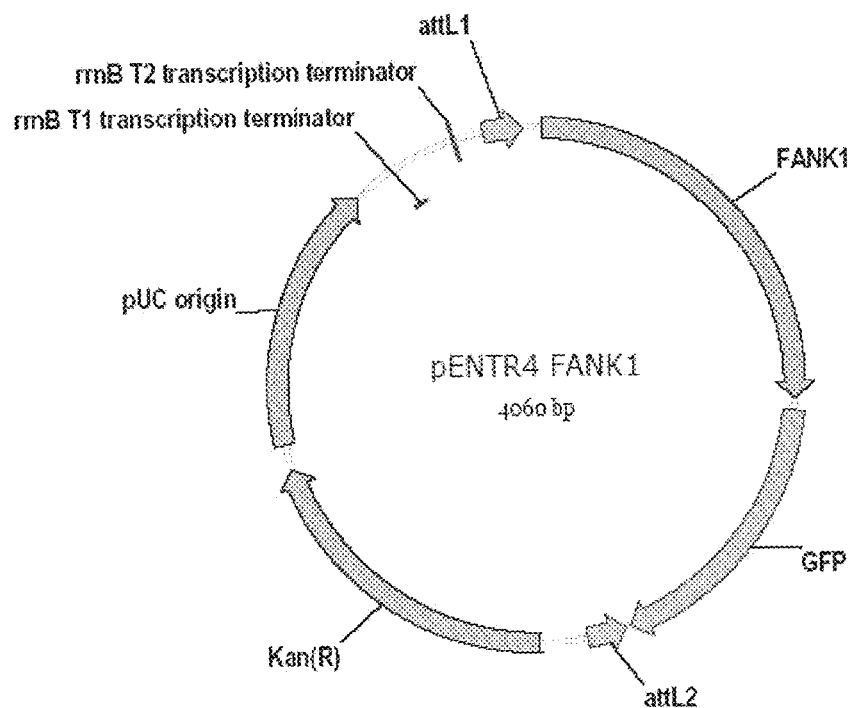
FIGS. 13B-G depict the vector including the cDNA sequences excluding the stop-codon of the 6 genes (B: FANK1, C: PLEKHK1, D: HPGD, E: DNAPTP6, F: Col5, G: Col6).
Figure 13C:
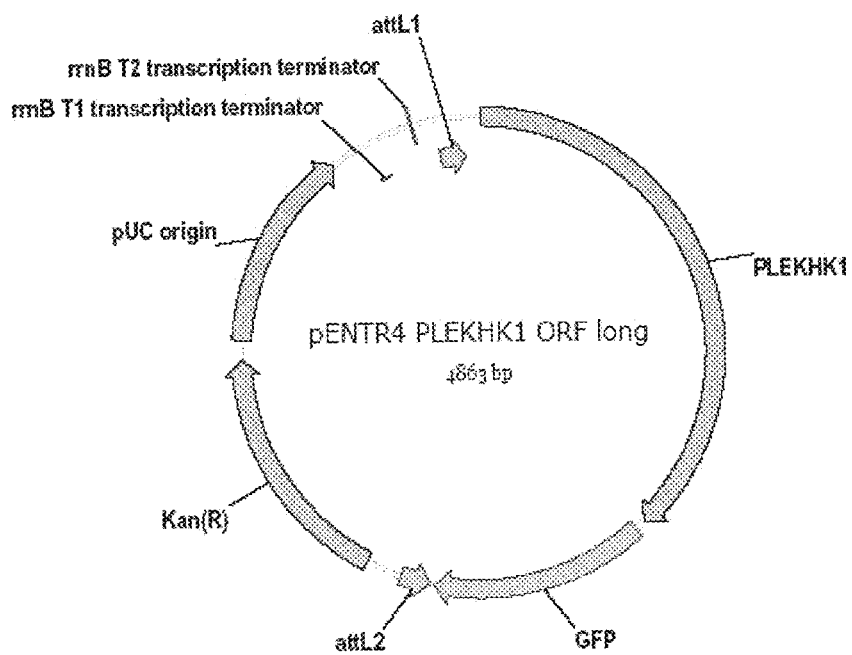
Figure 13D:
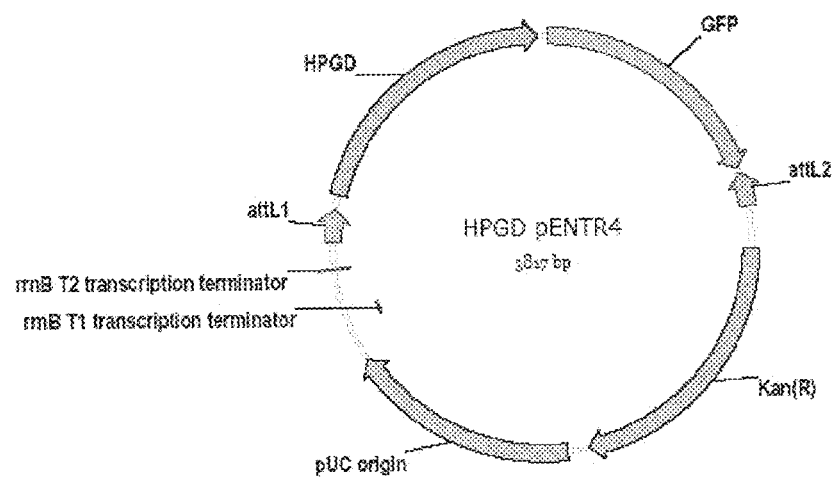
Figure 13E:
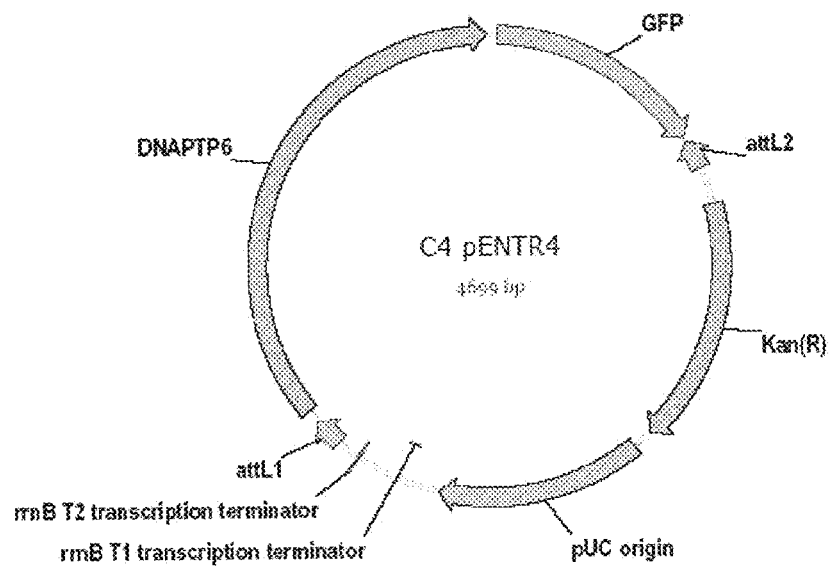
Figure 13F:
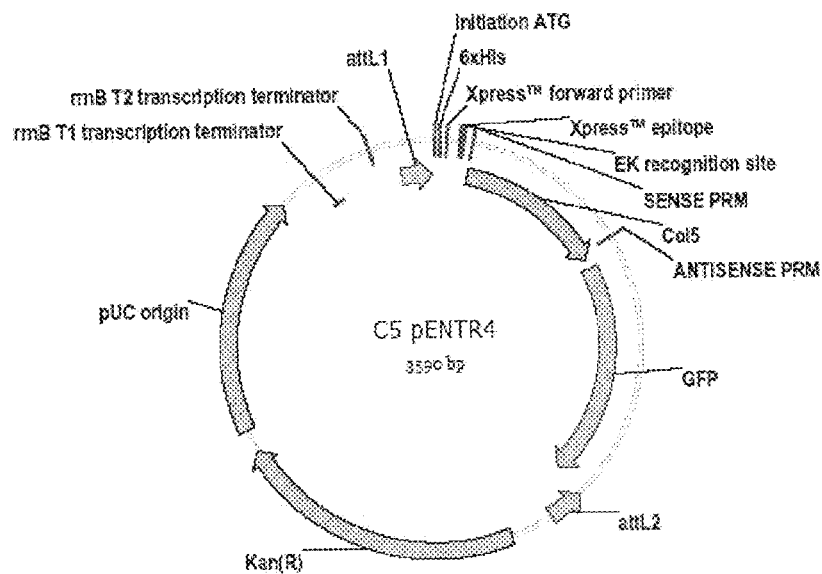
Figure 13G:
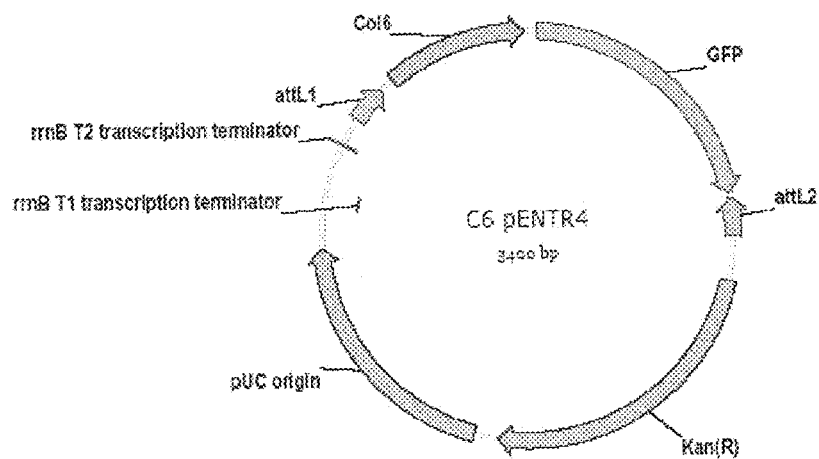
Figure 14A:
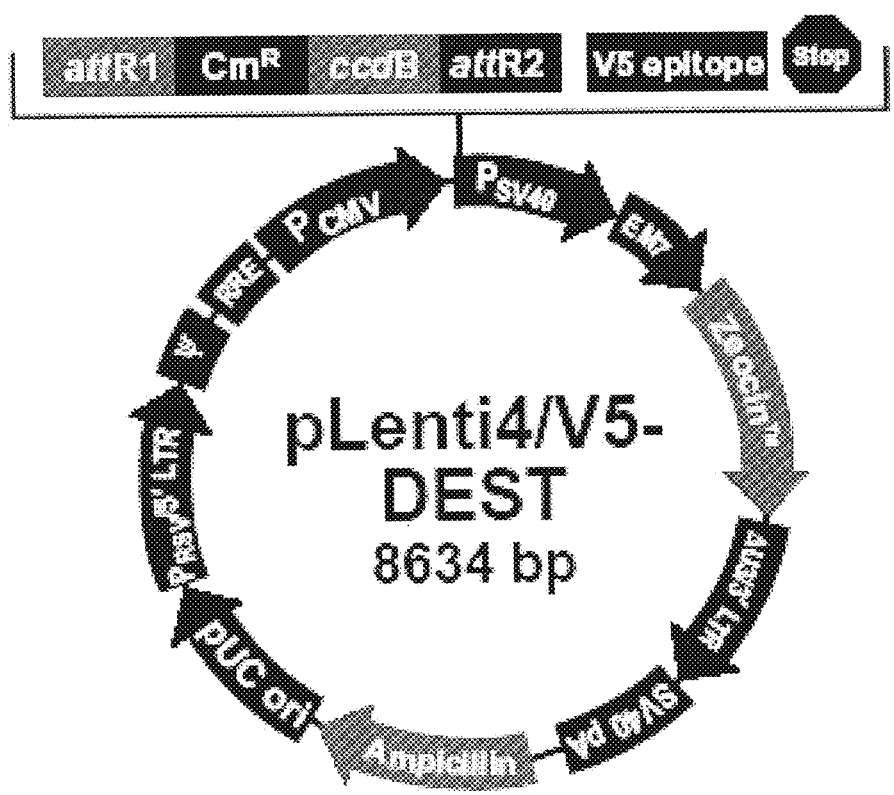
In FIG. 14A a map of the pLenti4/V5-DEST vector is shown. This vector (8634 bp) contains a CMV promotor, a HIV-1 psi (ψ) packaging signal, a HIV-1 Rev response element (RRE), an ampicillin resistance gene for bacterial selection, a blasticidin resistance gene for selection of infected mammalian cells and two attR sites for site specific recombination into the destination vector. Additionally, at the C-terminal end the vector includes a V5-epitope. Therefore, all proteins cloned into this vector are at the C-terminal eGFP- and V5-tagged.
Figure 14B:
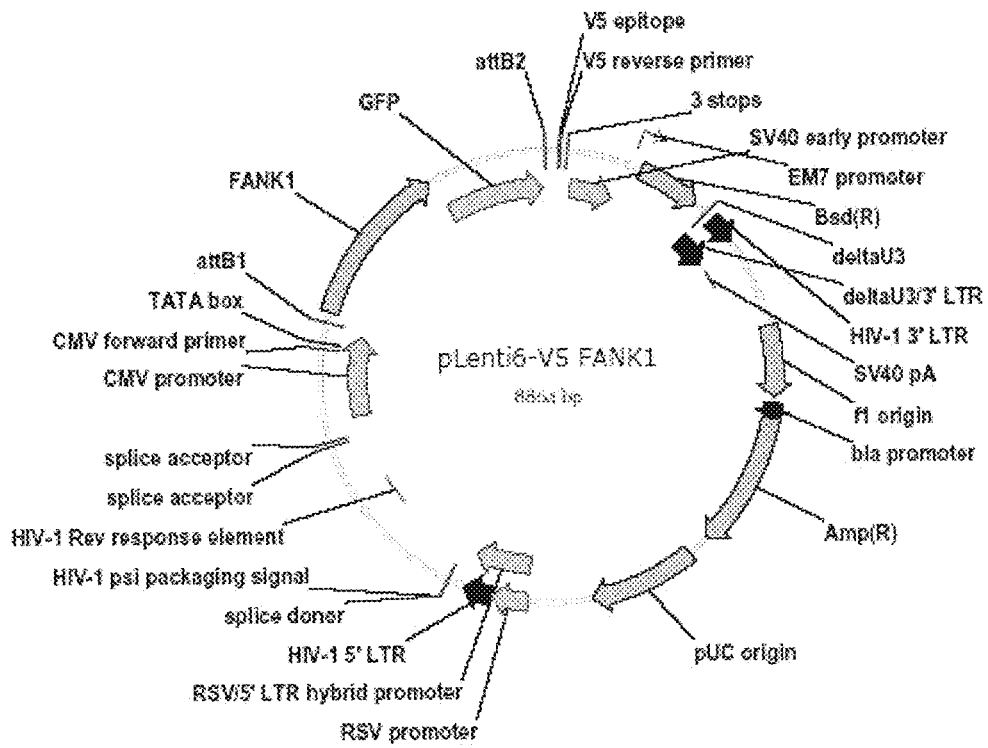
FIGS. 14B-G depict the vector including the cDNA sequences excluding the stop-codon of the 6 genes (B: FANK1, C: PLEKHK1, D: HPGD, E: DNAPTP6, F: Col5, G: Col6).
Figure 14C:
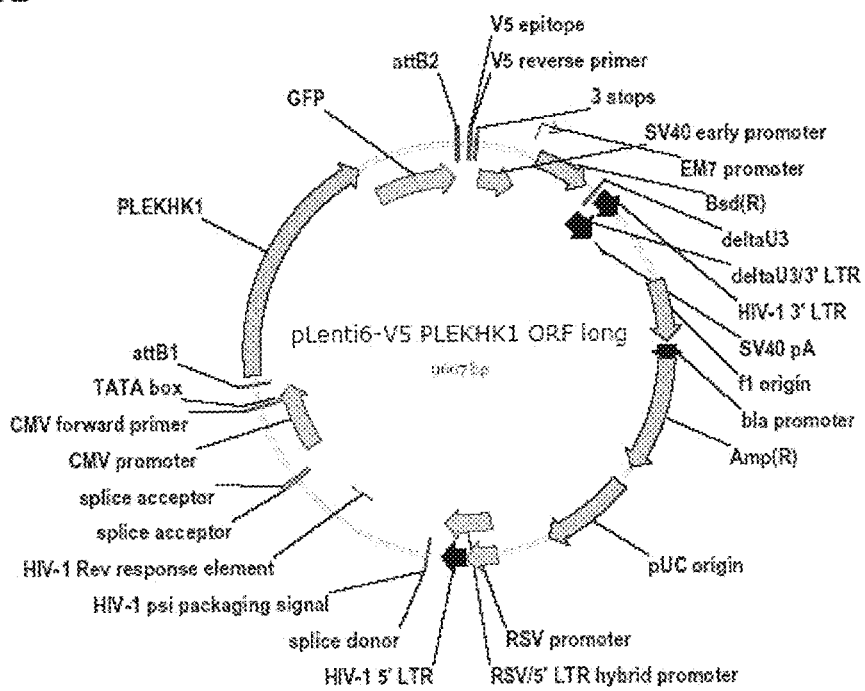
Figure 14D:
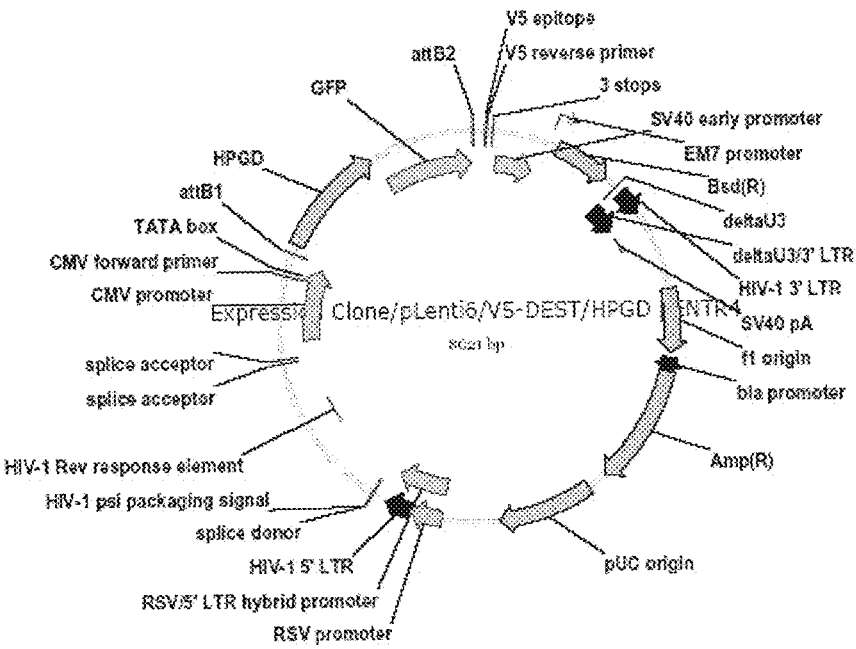
Figure 14E:
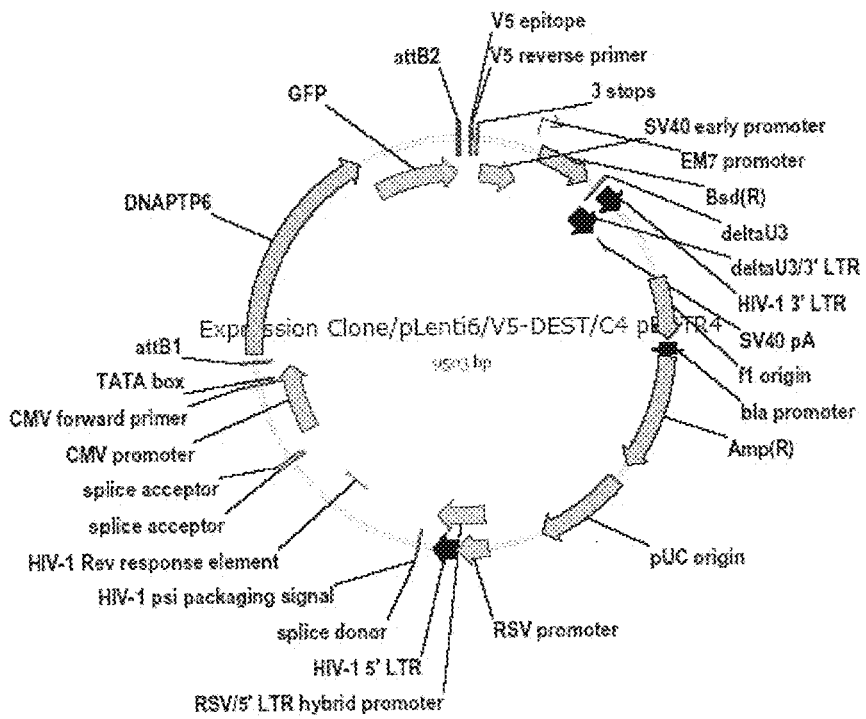
Figure 14F:
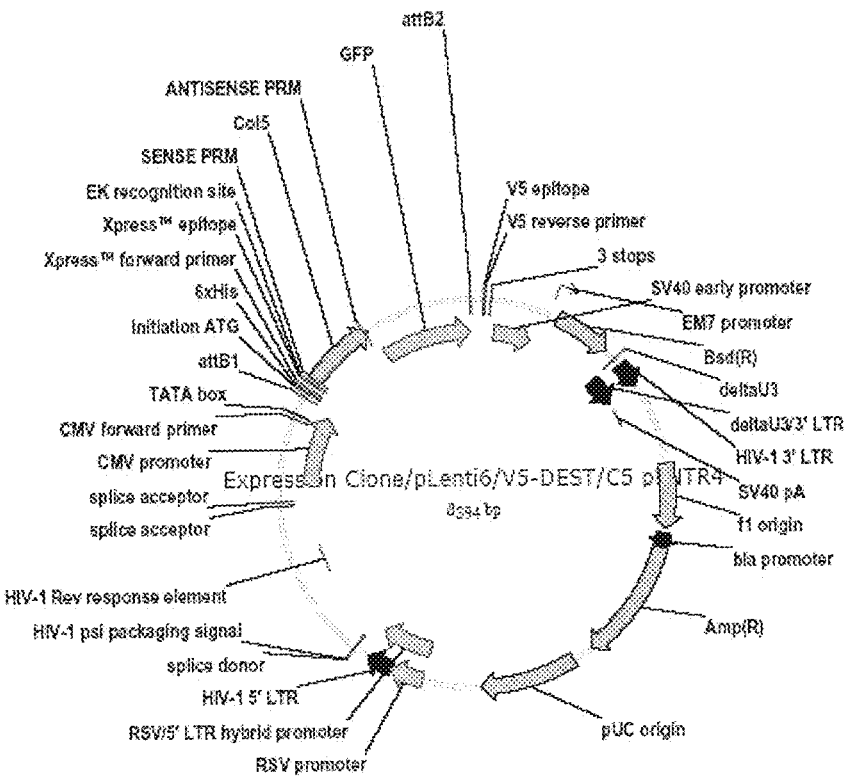
Figure 14G:
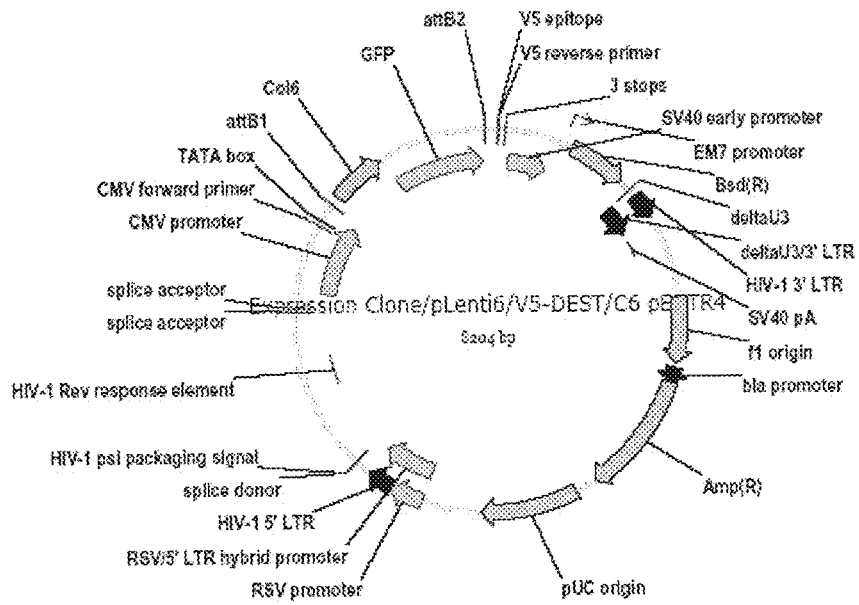
Figure 15A:
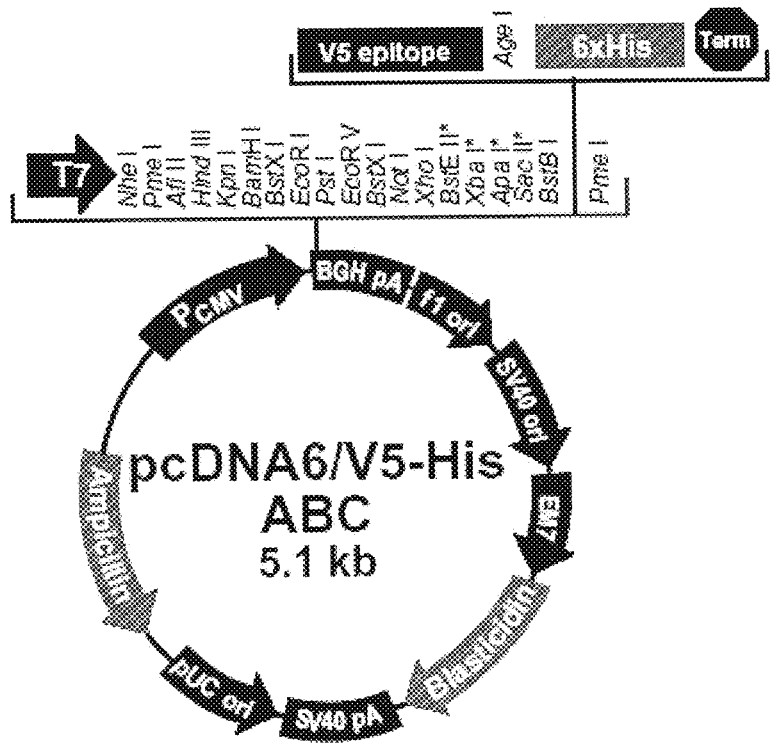
In FIG. 15A a map of the pCDNA6 vector is shown. This vector (5100 bp) contains a CMV promotor, an ampicillin resistance gene for bacterial selection and a blasticidin resistance gene for selection of infected mammalian cells. Additionally, at the C-terminal end the vector includes a V5-epitope as well as a 6× His-tag. Therefore, all proteins cloned into this vector are at the C-terminal V5- and His-tagged.
Figure 15B:
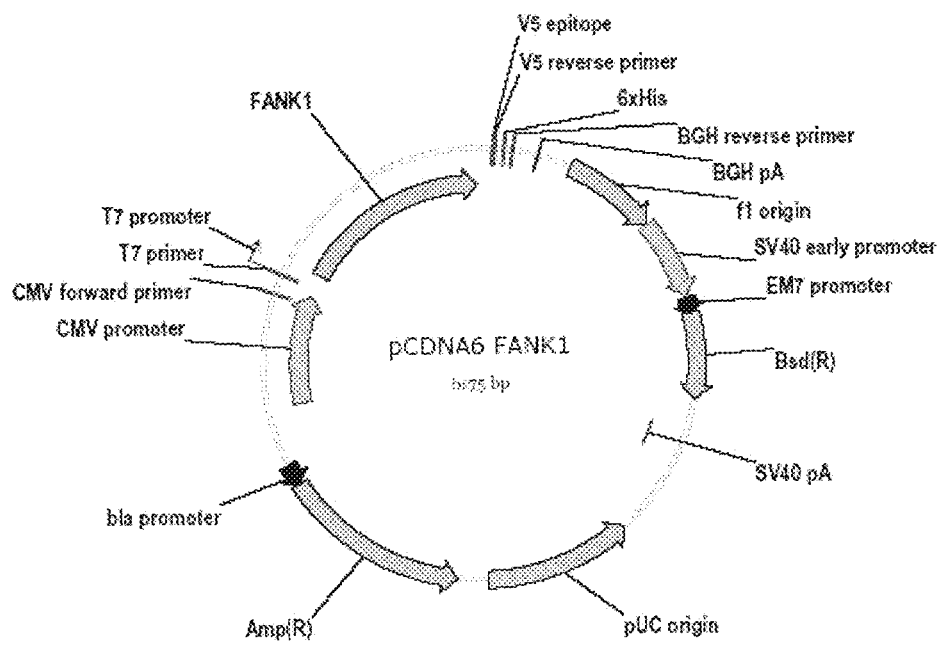
FIGS. 15B-G show pCDNA6-HisA vectors including th 6 genes (B: FANK1, C: PLEKHK1, D: HPGD, E: DNAPTP6, F: Col5, G: Col6).
Figure 15C:
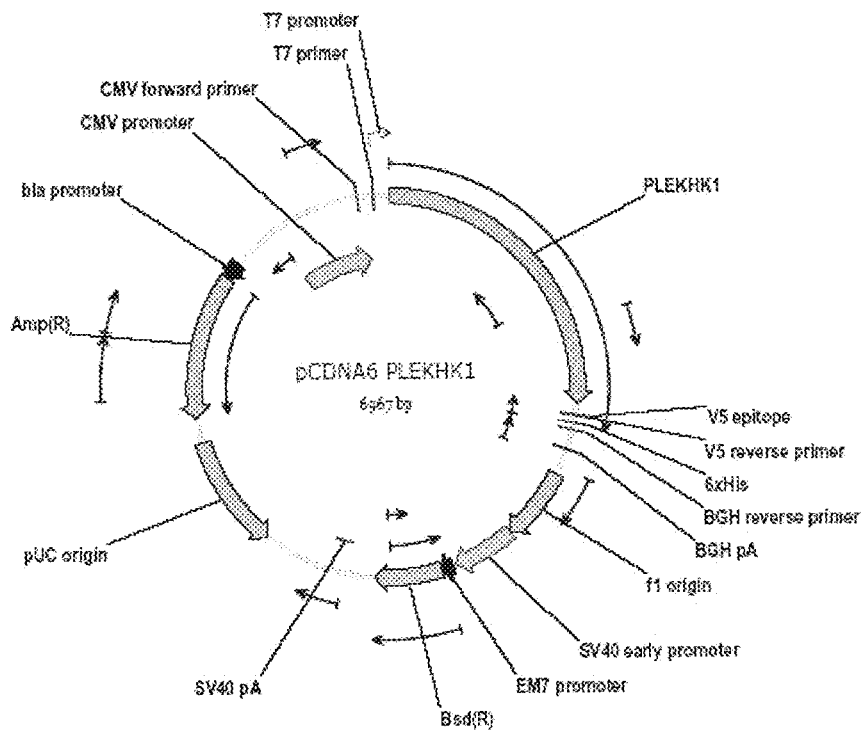
Figure 15D:
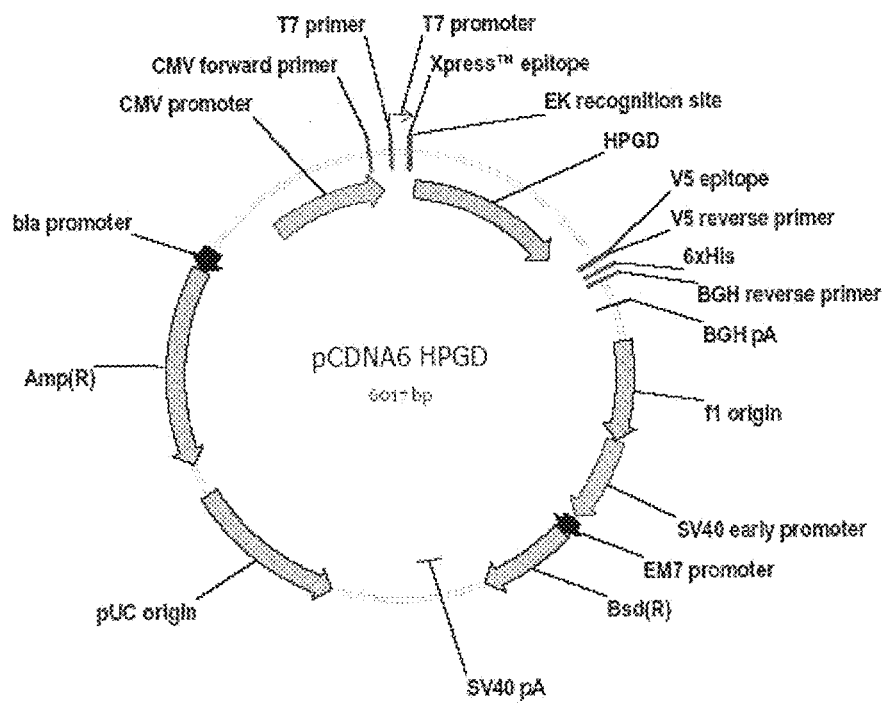
Figure 15E:
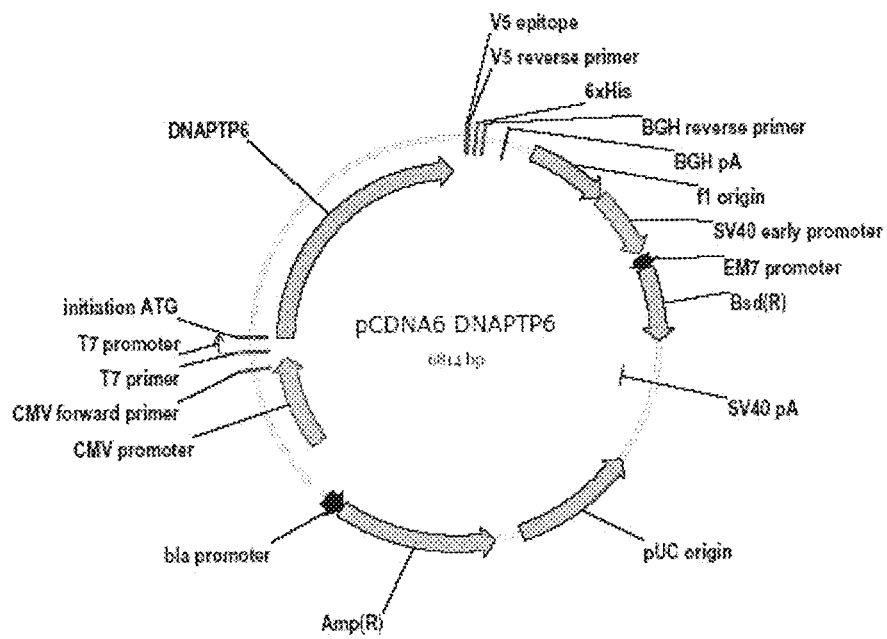
Figure 15F:
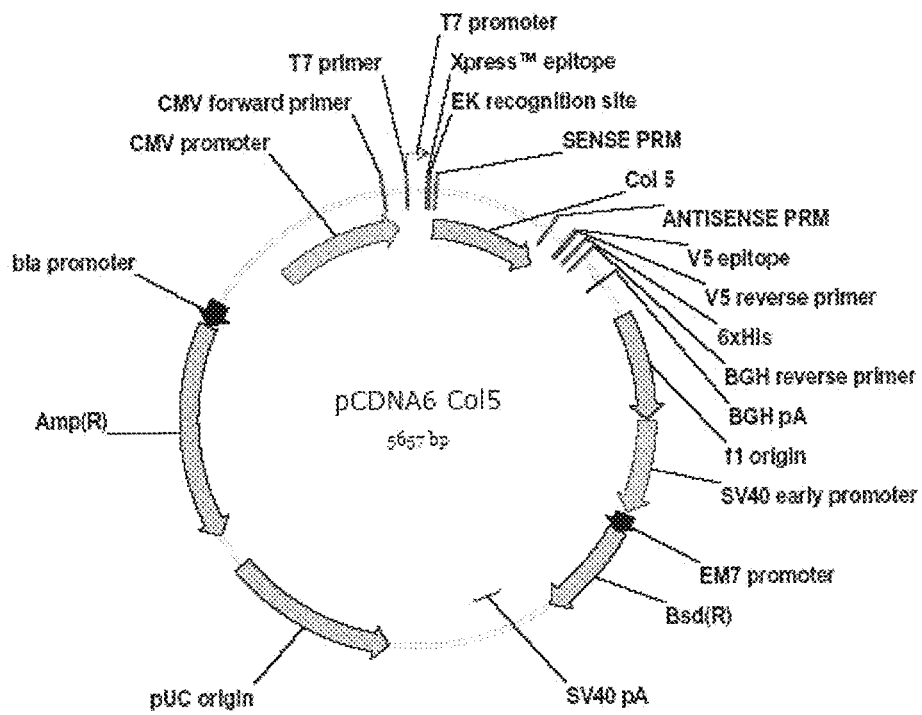
Figure 15G:
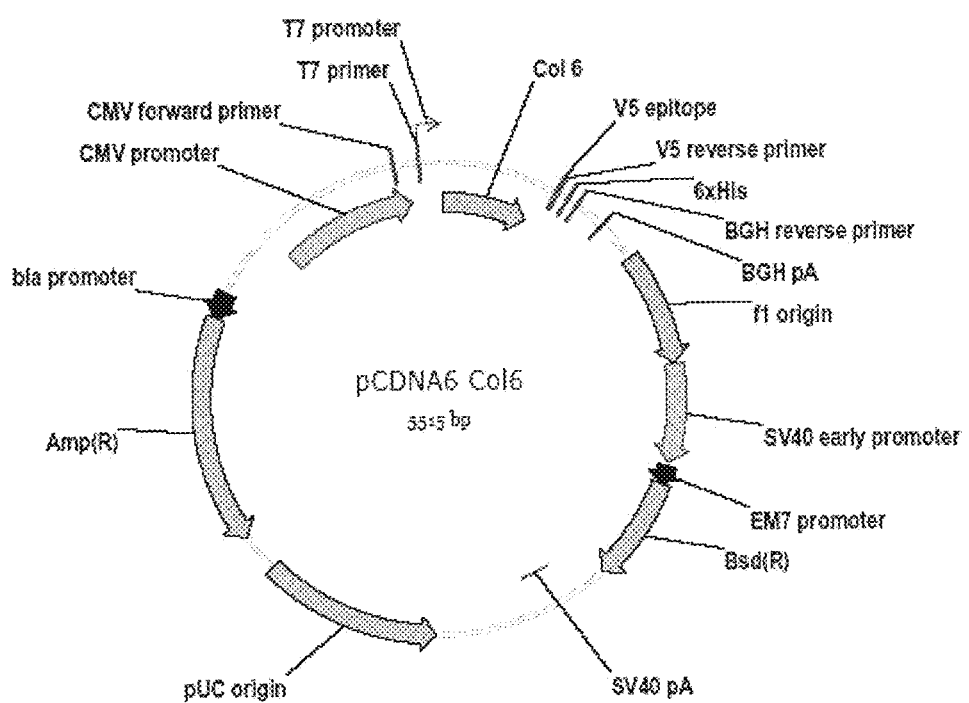

B. Cloning Steps:

In vitro expression of these 6 proteins encoded by cloned cDNA is possible using the bacterial expression vector (pTrcHis-TOPO; FIG. 11A). Expression of these genes in the bacteria allows the production of large amounts of proteins for isolation and purification. Purified protein can be used for specific antibody production (see Example 4). cDNA of the 6 genes were amplified by PCR including the stop-codon, gel purified (Jetsorb Gel extraction kit, Genomed GmBH, Löhne) and then cloned into the vector (FIGS. 11 B-G). The vector was transformed into E. coli, colonies were selected and analyzed for positive transformants by restriction analysis. cDNA was verified by sequencing analysis. Once the appropriate expression vectors containg the 6 genes are constructed, transformants with the right cDNA insert were grown over night in LB-medium. Protein expression was induced by addition of Isopropyl-β-D-thiogalactopyranosid (IPTG) and then purified either using the ProBond™ Purification system (Invitrogen) or QIAexpress® Ni-NTA Fast Start system (Qiagen) for 6xHis-tagged proteins. Protein isolation was demonstrated by western blot analysis.

A lentiviral expression vector (pLenti6/V5-Dest) was used to transduce mammalian cells with the 6 genes. For example, in Jurkats, an acute T cell leukemia cell line, the localization and function of the 6 proteins can be analyzed. Therefore, cDNA of the 6 genes was amplified by PCR without the stop-codon, gel purified (Jetsorb Gel extraction kit, Genomed GmBH, Löhne) and then cloned into the pTrcHis-TOPO vector as described before. From this vector the cDNA was cloned into the Entry Vector pENTR4™ (FIGS. 13 A, and 13 B-G) by restriction site mediated cloning. This vector is modified and includes an eGFP molecule so that a GFP-tagged fusion proteins is created from the cDNA clones. Colonies were again analyzed and confirmed by restriction analysis. Transformants with the right insert were then cloned into the pLenti6/V5-Dest vector using the gateway technology from Invitrogen.

The mammalian expression vector (pCDNA6-HisA) was used to express the 6 proteins in mammalian cells. cDNA of the 6 genes were amplified by PCR including the stop-codon, gel purified (Jetsorb Gel extraction kit, Genomed GmBH, Löhne) and then cloned into the pTrcHis-TOPO vector as described before (FIGS. 11 A and 11 B-G). From this vector the cDNA was cloned into the pCDNA6-HisA vector by restriction site mediated cloning (FIGS. 15 A and 15 B-G). Transformants were analyzed by restriction analysis and sequencing.

C. Stable Jurkat Lines:

Jurkat cells were infected using lentiviral vectors (pLenti6/V5-Dest) containing the 6 marker gene candidates coupled to GFP. Two days after infection cells were diluted to establish stable clones that were selected using Blasticidin (10 µg/ml). When stable cell lines were received, they were analyzed for GFP expression to verify the expression of the integrated fusion protein with FACS analysis and immune fluorescence. Afterwards, colocalization studies were performed to define the localization of the different proteins by immunofluorescence as well as immune precipitation to characterize the interaction partners of the 6 genes.

D. Functional Analysis of the 6 Genes in Primary Human CD4+ T Cells:

After achieving first information about the function and localization of the 6 genes in Jurkat cells several methods can be used to determine their role in primary human CD4+ T cells. With the specific antibodies achieved (see part antibody production) we want to verify whether the localization and binding partners we found in the infected Jurkat cells are the same in primary human $T_{reg}$ cells. Afterwards, we plan determine the function of the 6 genes. One method is to knock down the 6 genes in human $T_{reg}$ cells using siRNA. At this step, we will use siRNAs against the gene expression, gene transcription, gene translation as well as against the proteins of the 6 marker candidates. Thereby, the inhibitory potential of the $T_{reg}$ cells after deletion of the single genes can be tested, the cytokine profile as well as the phenotype of the $T_{reg}$ cells.

The second strategy is to infect conventional CD4+CD25− T cells with the mammalian expression vectors (either pCDNA6-HisA or pLenti6/V5-Dest) of the 6 genes and to analyze, whether expression of these genes leads to the development of a regulatory phenotype and/or function.

Example 4

Generation of Antibodies

One method to generate antibodies against Cologne 1-6 involves administering an antigen presenting cell (APC) to animals, e.g. mouse, rat, rabbit, goat. This results in the activation of B-cells to produce antibodies recognizing $T_{reg}$ cells in a Cologne 1-6 specific fashion. The APC can be pulsed with Cologne 1-6 or a peptide of Cologne 1-6 that binds to a major histocompatibility complex molecule. Another method includes the generation of antibodies against Cologne 1-6 by administering Cologne 1-6 or a peptide of Cologne 1-6 that binds to a major histocompatibility complex molecule, which is processed by an antigen presenting cell, which, in turn, activates B-cells to produce antibodies recognizing $T_{reg}$ cells in a Cologne 1-6 specific fashion. The Cologne 1-6 polypeptide or peptide of Cologne 1-6 used in this method can be administered in association with an adjuvant.

Alternatively, one method involves administering a nucleic acid molecule encoding Cologne 1-6 or a peptide of Cologne 1-6 that binds to a major histocompatibility complex molecule. The nucleic acid molecule is expressed so that it can be processed by an antigen presenting cells, which activate B-cells to produce antibodies recognizing Cologne 1-6 in a Cologne 1-6 specific fashion. The nucleic acid molecule encoding Cologne 1-6 or a peptide of Cologne 1-6 can be present in an expression vector.

After an animal has been challenged several times with Cologne 1-6 B cells from the spleen or lymph nodes are then fused with myeloma tumor cells that can grow indefinitely in culture and that have lost the ability to produce antibodies. This fusion is done by making the cell membranes more permeable by the use of polyethylene glycol or electroporation. The fused hybridomas cells are sufficiently diluted to ensure clonality and grown. The antibodies from the different clones are then tested for their ability to bind to the antigen (for example with a test such as ELISA) or immuno-dot blot, and the most sensitive one is picked out. Monoclonal antibodies are then produced in cell culture by e.g. fermentation chambers.

Another method of generating antibodies against Cologne 1-6 involves usage of Cologne 1-6 or a peptide of Cologne 1-6 to bind antibodies expressed by a phage library. Numerous antibodies are expressed in the library as fusions with the coat protein of a bacteriophage, so that they are displayed on the surface of the viral particle. DNA extracted from interacting phages contains the sequences of the specific antibodies recognizing Cologne 1-6 in a Cologne 1-6 specific fashion.

| SEQ ID | Designation |
|---|---|
| 1/2 | >gi|34222185|ref|NM_145235.2| *Homo sapiens* fibronectin type III and ankyrin repeat domains 1 (FANK1; Col1), mRNA and CDS |
| 3/4 | >gi|26190613|ref|NM|145307.2| *Homo sapiens* pleckstrin homology domain containing, family K member 1 (PLEKHK1 long variant; Col2), mRNA and CDS |
| 5/6 | >gi_19343626_gb_BC025765.1| *Homo sapiens* pleckstrin homology domain containing, family K member 1 (PLEKHK1 short variant), mRNA and CDS |
| 7/8 | >gi_40226515_gb_BC018986.2_| *Homo sapiens* Hydroxyprostaglandin dehydrogenase 15-(NAD) (HPGD; Col3), mRNA and CDS |
| 9/10 | >gi_7661597_ref_NM_015535.1| *Homo sapiens* DNA polynnerase-transactivated protein 6 (DNAPTP6; Col4), mRNA and CDS |
| 11/12 | >gi|89225661|ref|NM_018166.1| *Homo sapiens* chromosome 1 open reading frame 78 (C1orf78; Col5), mRNA and CDS |
| 13/14 | >gi_46409471_ref_NM_207423.1| *Homo sapiens* FLJ45983 protein (FLJ45983; Col6), mRNA and CDS |
| 15/16 | >gi|4501882|ref|NM_001613.1| *Homo sapiens* actin, alpha 2, smooth muscle, aorta (ACTA2), mRNA and CDS |
| 17/18 | >gi|21536442|ref|NM_003571.2| *Homo sapiens* beaded filament structural protein 2, phakinin (BFSP2), mRNA and CDS |
| 19/20 | >gi|22538813|ref|NM_002985.2| *Homo sapiens* chemokine (C-C motif) ligand 5 (CCL5), mRNA and CDS |
| 21/22 | >gi|30795213|ref|NM_001838.2| *Homo sapiens* chemokine (C-C motif) receptor 7 (CCR7), mRNA and CDS |
| 23/24 | >gi|58331233|ref|NM_000074.2| *Homo sapiens* CD40 ligand (TNF superfamily, member 5, hyper-IgM syndrome) (CD40LG), mRNA and CDS |
| 25/26 | >gi|83700229|ref|NM_005214.3| *Homo sapiens* cytotoxic T-lymphocyte-associated protein 4 (CTLA4), transcript variant 1, mRNA and CDS |
| 27/28 | >gi|83700230|ref|NM_001037631.1| *Homo sapiens* cytotoxic T-lymphocyte-associated protein 4 (CTLA4), transcript variant 2, mRNA and CDS |
| 29/30 | >gi|125987605|ref|NM_001912.3| *Homo sapiens* cathepsin L1 (CTSL1), transcript variant 1, mRNA and CDS |
| 31/32 | >gi|125987604|ref|NM_145918.2| *Homo sapiens* cathepsin L1 (CTSL1), transcript variant 2, mRNA and CDS |
| 33/34 | >gi|22538469|ref|NM_005442.2| *Homo sapiens* eomesodermin homolog (*Xenopus laevis*) (EOMES), mRNA and CDS |
| 35/36 | >gi|32490571|ref|NM_012307.2| *Homo sapiens* erythrocyte membrane protein band 4.1-like 3 (EPB41L3), mRNA and CDS |
| 37/38 | >gi|93277091|ref|NM_052966.2| *Homo sapiens* family with sequence similarity 129, member A (FAM129A), transcript variant 2, mRNA and CDS |
| 39/40 | >gi|113428621|ref|XM_001131379.1| PREDICTED: *Homo sapiens* Fc fragment of IgG binding protein (FCGBP), mRNA and CDS |
| 41/42 | >gi|4503718|ref|NM_002012.1| *Homo sapiens* fragile histidine triad gene (FHIT), mRNA and CDS |
| 43/44 | gi|16552331|ref|NM_005803.2| *Homo sapiens* flotillin 1 (FLOT1), mRNA and CD |
| 45/46 | >gi|31982942|ref|NM_014009.2| *Homo sapiens* forkhead box P3 (FOXP3), mRNA and CDS |
| 47/48 | >gi|7108345|ref|NM_012483.1| *Homo sapiens* granulysin (GNLY), transcript variant 519, mRNA and CDS |

Sequence Listing-Free Text

| SEQ ID | Designation |
|---|---|
| 49/50 | >gi|7108343|ref|NM_006433.2| *Homo sapiens* granulysin (GNLY), transcript variant NKG5, mRNA and CDS |
| 51/52 | >gi|94721348|ref|NM_022307.2| *Homo sapiens* islet cell autoantigen 1, 69 kDa (ICA1), transcript variant 1, mRNA and CDS |
| 53/54 | >gi|947213491|ref|NM_004968.2| *Homo sapiens* islet cell autoantigen 1, 69 kDa (ICA1), transcript variant 2, mRNA and CDS |
| 55/56 | >gi|286101501|ref|NM_002185.2| *Homo sapiens* interleukin 7 receptor (IL7R), mRNA and CDS |
| 57/58 | >gi|24430213|ref|NM_001558.2| *Homo sapiens* interleukin 10 receptor, alpha (IL10RA), mRNA and CDS |
| 59/60 | >gi|61098051|ref|NM_020940.2| *Homo sapiens* KIAA1600 (KIAA1600), mRNA and CDS |
| 61/62 | >gi|45007001|ref|NM_203463.1| *Homo sapiens* LAG1 homolog, ceramide synthase 6 (*S. cerevisiae*) (LASS6), mRNA and CDS |
| 63/64 | >gi|51972195|ref|NM_001004307.1| *Homo sapiens* hypothetical LOC339541 (MGC33556), mRNA and CDS |
| 65/66 | >gi|22035639|ref|NM_002413.3| *Homo sapiens* microsomal glutathione S-transferase 2 (MGST2), mRNA and CDS |
| 67/68 | >gi|47519797|ref|NM_000631.3| *Homo sapiens* neutrophil cytosolic factor 4, 40 kDa (NCF4), transcript variant 1, mRNA and CDS |
| 69/70 | >gi|47519769|ref|NM_013416.2| *Homo sapiens* neutrophil cytosolic factor 4, 40 kDa (NCF4), transcript variant 2, mRNA and CDS |
| 71/72 | >gi|5453765|ref|NM_006159.1| *Homo sapiens* NEL-like 2 (chicken) (NELL2), mRNA and CDS |
| 73/74 | >gi|82659104|ref|NM_014241.3| *Homo sapiens* protein tyrosine phosphatase-like (proline instead of catalytic arginine), member A (PTPLA), mRNA and CDS |
| 75/76 | >gi|11038651|ref|NM_004219.2| *Homo sapiens* pituitary tumor-transforming 1 (PTTG1), mRNA and CDS |
| 77/78 | >gi|84872014|ref|NR_002734.1| *Homo sapiens* pituitary tumor-transforming 3 (PTTG3) on chromosome 8 and CDS |
| 79/80 | >gi|44889474|ref|NM_015213.2| *Homo sapiens* RAB6 interacting protein 1 (RAB6IP1), mRNA and CDS |
| 81/82 | >gi|46249389|ref|NM_016836.2| *Homo sapiens* RNA binding motif, single stranded interacting protein 1 (RBMS1), transcript variant 1, mRNA and CDS |
| 83/84 | >gi|46249391|ref|NM_016839.2| *Homo sapiens* RNA binding motif, single stranded interacting protein 1 (RBMS1), transcript variant 2, mRNA and CDS |
| 85/86 | >gi|46249390|ref|NM_002897.3| *Homo sapiens* RNA binding motif, single stranded interacting protein 1 (RBMS1), transcript variant 3, mRNA and CDS |
| 87/88 | >gi|45827773|ref|NM_021205.4| *Homo sapiens* ras homolog gene family, member U (RHOU), mRNA and CDS |
| 89/90 | >gi|33356175|ref|NM_002971.2| *Homo sapiens* SATB homeobox 1 (SATB1), mRNA and CDS |

-continued

Sequence Listing-Free Text

| SEQ ID | Designation |
|---|---|
| 91/92 | >gi|6031196|ref|NM_003005.2| *Homo sapiens* selectin P (granule membrane protein 140 kDa, antigen CD62) (SELP), mRNA and CDS |
| 93/94 | >gi|9910361|ref|NM_020163.1| *Homo sapiens* senna domain, immunoglobulin domain (Ig), short basic domain, secreted, (semaphorin) 3G (SEMA3G), mRNA and CDS |
| 95/96 | >gi|52851445|ref|NM_005412.4| *Homo sapiens* serine hydroxymethyltransferase 2 (mitochondrial) (SHMT2), mRNA and CDS |
| 97/98 | >gi|21265027|ref|NM_003473.2| *Homo sapiens* signal transducing adaptor molecule (SH3 domain and ITAM motif) 1 (STAM), mRNA and CDS |
| 99/100 | >gi|38016910|ref|NM_004099.4| *Homo sapiens* stomatin (STOM), transcript variant 1, mRNA and CDS |
| 101/102 | >gi|38016906|ref|NM_198194.1| *Homo sapiens* stomatin (STOM), transcript variant 2, mRNA and CDS |
| 103/104 | >gi|51702235|ref|NM_001003799.1| *Homo sapiens* TCR gamma alternate reading frame protein (TARP), nuclear gene encoding mitochondrial protein, transcript variant 1, mRNA and CDS |
| 105/106 | >gi|51702237|ref|NM_001003806.1| *Homo sapiens* TCR gamma alternate reading frame protein (TARP), nuclear gene encoding mitochondrial protein, transcript variant 2, mRNA and CDS |
| 107/108 | >gi|42518079|ref|NM_003202.2| *Homo sapiens* transcription factor 7 (T-cell specific, HMG-box) (TCF7), transcript variant 1, mRNA and CDS |
| 109/110 | >gi|42518077|ref|NM_201632.1| *Homo sapiens* transcription factor 7 (T-cell specific, HMG-box) (TCF7), transcript variant 2, mRNA and CDS |
| 111/112 | >gi|42518073|ref|NM_201633.1| *Homo sapiens* transcription factor 7 (T-cell specific, HMG-box) (TCF7), transcript variant 3, mRNA and CDS |
| 113/114 | >gi|42714656|ref|NM_201634.1| *Homo sapiens* transcription factor 7 (T-cell specific, HMG-box) (TCF7), transcript variant 4, mRNA and CDS |
| 115/116 | >gi|23312365|ref|NM_001066.2| *Homo sapiens* tumor necrosis factor receptor superfamily, member 1B (TNFRSF1B), mRNA and CDS |
| 117/118 | >gi|48255912|ref|NM_006470.3| *Homo sapiens* tripartite motif-containing 16 (TRIM16), mRNA and CDS |
| 119/120 | >gi|12056478|ref|NM_021995.1| *Homo sapiens* urotensin 2 (UTS2), transcript variant 1, mRNA and CDS |
| 121/122 | >gi|12056478|ref|NM_021995.1| *Homo sapiens* urotensin 2 (UTS2), transcript variant 1, mRNA and CDS |
| 123-140 | primers for isolation of Cologne 1-6 |
| 141 | vector pTrcHis FANK1 |
| 142 | vector pTrcHis PLEKHK1 long |
| 143 | vector pTrcHis HPGD |
| 144 | vector pTrcHis DNAPTP6 |
| 145 | vector pTrcHis Col5 (C1orf78) |
| 146 | vector pTrcHis Col6 (FLJ45983) |
| 147 | vector pTrcHis Features of pTrcHis-TOPO trc Promoter and 5' UTR: bases 190-382 35 region bases 193-198 10 region: bases 216-221 lac Operator site: bases 228-248 rrnB anti-termination sequence: bases 264-333 T7 gene 10 translational enhancer bases 346-354 Ribosome binding site: 369-373 pTrcHis forward priming site bases 370-390 |

Sequence Listing-Free Text

| SEQ ID | Designation |
|---|---|
| | Minicistron: bases 383-409<br>Reinitiation RBS: bases 398-403<br>Initiation ATG: bases 413-415<br>6xHiS tag bases 425-442<br>Xpress ™ epitope: bases 482-505<br>Xpress ™ forward priming site: bases 445-463<br>Enterokinase cleavage site: bases 491-505<br>TOPO Cloning site. bases517-518<br>pTrcHis reverse priming site: bases 574-591<br>rrnB $T_1$ and $T_2$ transcription termination seq. bases 624-781<br>bla promoter: bases 1002-1059<br>Ampicillin resistance gene (bla): bases 1060-1920<br>pBR322-derived origin: bases 2065-2738<br>Lac Repressor ($lacI^q$): bases 3392-4351 |
| 148 | vector pENTR4<br>Features of pENTR4<br>rrnB T1 transcription termination sequence: bases 106-149<br>rrnB T2 transcription termination sequence: bases 281-308<br>attL1: bases 358-457 (complementary strand)<br>ccdB gene: bases 615-920<br>attL2: bases 949-1048<br>Kanamycin resistance gene: bases 1171-1980<br>pUC origin: bases 2044-2717 |
| 149 | vector pENTR4 eGFP |
| 150 | vector pLenti4/V5_DEST |
| 151 | vector pcDNA6-V5-His |
| 152-255 | MHC fragment of Col1 (SEQ ID NO: 2) |
| 256-435 | MHC fragment of Col2 (SEQ ID NO: 4) |
| 436-536 | MHC fragment of Col3 (SEQ ID NO: 8) |
| 537-660 | MHC fragment of Col4 (SEQ ID NO: 10) |
| 661-708 | MHC fragment of Col5 (SEQ ID NO: 12) |
| 709-734 | MHC fragment of Col6 (SEQ ID NO: 14) |
| 735-736 | >gi/85218985/ref/NM 001010923.1/*Homo sapiens* chromosome 6 open reading frame 190 (C6orf190), mRNA and CDS |

SEQUENCE LISTING (736 sequences)

SEQ ID NO: 1 - DNA, 1395 bp, Homo sapiens
  CDS (105)..(1142)
catttcgcctccgggttgtcagggcaaccgtagcgacgccggccctggctgagaggcgttaggagtccgggggttcgcccgcggaggccggggagcagccgaccatggagccccagagaatcatgccaccctcaaagcctcatccacctgtcgtgggcaaagtgactcatcacagcattgaattatactgggatctggaaaagaaagccaaacgccaaggacctcaagagcagtggttcaggttctcgattgaagaagaagaccccaaaatgcacacttatggtatcatttatacgggatatgcaacgaagcatgttgttgaaggtctggaaccaaggacgctgtacagatttcgcctgaaggtcaccagcccctctggggagtgtgagtacagcccactcgtctcagtgtctacaaccagagagcccataagtagtgagcacttgcaccgggctgtcagtgtgaatgatgaagatttgctggtccgaatacttcaaggaggccgtgttaaggttgatgttcccaataagtttggctttaccgctctgatggttgctgcccagaaaggatacaccaggcttgtgaaaatcctagtttctaatggcacagacgtgaatctgaagaatggaagtggcaaggacagtctaatgctggcgtgctatgcgggacacctagatgttgtgaaatatctccgaagacatggcgcttcttggcaggctagagacctgggaggctgtacagctctgcactgggctgcagatggaggccactgcagtgtgattgagtggatgataaaggatggctgtgaggtagacgtcgtggacactggttcaggatggaccccactcatgagagtctctgcggtgtcgggaaatcagagggtggcctctcttctaattgatgctggggccaatgtgaatgtgaaggacagaaatggaaagacgccccttatggtggctgtgttaaataatcatgaagagttagttcagttacttcttgacaaaggggcagatgcaagtgtaaaaaatgagttcggcaaaggtgtcctagaaatggccagagtttttgacagacagagtgtagtctccttattagaagaaaggaaaaaaaagcagaggccaaagaagtcttgtgtctgctgatgagagcaccactcatctgcgaaacgcacgtaaaacaaagtgaaccgtgactgttaaactagggatgggaaattctgcatcttggggggctgtacatttatttatttagttgaagattcactgatcccactttgaaatacatctttttacctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 2 - protein, 345 aa, Homo sapiens
MEPQRIMPPSKPHPPVVGKVTHHSIELYWDLEKKAKRQGPQEQWFRFSIEEEDPKMHTYGIIYTGYATKHVVEGLEPRTLYRFRLKVTSPSGECEYSPLVSVSTTREPISSEHLHRAVSVNDEDLLVRILQGGRVKVDVPNKFGFTALMVAAQKGYTRLVKILVSNGTDVNLKNGSGKDSLMLACYAGHLDVVKYLRRHGASWQARDLGGCTALHWAADGGHCSVIEWMIKDGCEVDVVDTGSGWTPLMRVSAVSGNQRVASLLIDAGANVNVKDRNGKTPLMVAVLNNHEELVQLLLDKGADASVKNEFGKGVLEMARVFDRQSVVSLLEERKKKQRPKKSCVC

SEQ ID NO: 3 - DNA, 6659 bp, Homo sapiens
  CDS (98)..(1927)
ccgggcggttggcgtcctctgcggctcctgccaggggcgggcttttcaaatcttccctttgaaggagtggcgacggcccggacagttcgcgttggagatggaggggccgagcctgaggggtcctgcgctccgcctggcggggcttcccacccagcaggactgcaacattcaagaaaaaatagacttagaaattcgaatgcgagaaggaatatggaaactcctttctctgagcactcagaaagatcaagttttacatgcagttaagaatctcatggtgtgcaatgctcgactaatggcctatacatcggagctacagaaattagaagaacagattgcaaatcagactggaagatgtgatgtgaaatttgaaagtaaagaacgaacagcatgtaaaggaaagattgccatatcagatattcgaataccactaatgtggaaagactctgatcacttcagcaataaagaacgatcacgacgctatgccattttttgtttattcaaaatgggagctaatgtgtttgatactgatgtggtgaatgtggataaaacaatcacagatatatgttttgaaaatgtaaccatatttaatgaagcagggccagactttcagataaaggtggaagtgtatagttgctgtacagaagaatcttctataaccaacacaccaaaaaagctagctaagaaactcaagacatctataagtaaagctacaggaaagaaaataagttcagtgcttcaagaagaggatgatgaaatgtgcttgctcctcagctctgctgtttttggtgtaaagtataatttgctagctcacactaccctaaccttggaaagtgctgaggatagtttcaagacccataatctgtctattaatggaaatgaggagtcttcattttggcttcccctgtatggcaacatgtgctgccgactagttgcccagccagcttgtatggctgaggatgcatttgcaggatttcttaatcagcagcaaatggtagaaggtctgattagttggagaaggttgtattgtgttttgcgaggaggtaaactctattgtttttacagtccagaggaaattgaagctaaagtggaaccagctttggtagtacccattaacaaggaaaccagaatccgggcaatggataaggatgccaagaaaagaatccataatttctctgtcatcaatcctgttcctggacaagctataactcagatttttgcagttgacaatagagaagatcttcagaagtggatggaagccttctggcagcatttctttgatcttagccaatggaagcactgttgtgaagaacttatgaaaattgagattatgtcaccacggaaaccacctttgttcttgacaaaagaggcaacctcagtctaccatgatatgagcattgattcacctatgaaacttgaaagtttaacggatataatacaaaaaaaaattgaagagacaaatgggcagttccttattggtcagcatgaagaatccttaccacctccttgggccacactctttgatggtaaccatcaaatggtcatccagaaaaaggtactgtatcctgcaagtgagccattacatgatgaaaaagggaaaaagagacaagctccccttcctccttctgataaacttccattcagcttaaaatcacagagtaacacagatcaattggttaaggacaactggggaaaaacaagtgtatctcagacatcgtctttggataccaaactatcaactctaatgcatcacttacagaaaccaatggctgctcctcgaaaacttctgcctgccaggagaaatagattaagtgatggtgagcacacagacactaaaaccaattttgaagccaagccagtgccagctccaaggcagaaatccatcaaagacattctggaccctagatcatggctgcaggcacaagtatagaaaactcttaatgataaaacatttaacaaaatctataactgtgaagcttaattcagaggcattatagaataatgtgtaattatataggtaaatatagtgatttataccaataattaataagctattaggtatagaaaaacattttataatgaagaagtggatttctcttttactcctgatttgcagaatgtaagtgatttctccagcagtgtgcaagaggcagtttctagacaatatcctaattgttggaagggttaatttattcctgaattagtaccaggcagtgaataagccctaggcagaataaagcattaaaatttcttttggggagagactgtctagtaatttaaaatgtgttaaatatgaaccatattctcattgtgagaattttaatactaatggaatgtttcaaaggttttattcaaaccacaaattatagaatccacccaagaaaattttcttagcattctggaattctcatctaatggttcactggctctcatctattgtttaactcactagtttataggcctgaccttttaaattcctgggataaattttagaatattaaattcttcatctttaaagggaatttgtaatgtgctattcaaacttgtttccttgatgagccctgaaatactgttgacattaactttcataaatgaagcataacacttactagtttagagaaatggtagatgaaatgctctttacattcaattttctgtgtgtggtgctaatttccattgtgactttggaatttagggaagtgagtagctgatcaacaccttaaaattcatttaatacttatttaaaaagaagatgagagattcaaaaatatcagaaaagttggccatggtaaataattttcagaattcttttttaaaattttaattagatttccttttcctagtaagagttgatgtctgctagtggtatttttcattaaatgtcatattcttacaacagtgacattggaatcatttccataggaggtaatttccatagcaactaatcatagtgacccaaacaggattataaagtcaagtgaggaataaatagcagaaaaataccttaaaggaacaaaaaatccattttttataataatgctttttgtaaacaagagcagaacagttttaaaaatctaattagaatttccaaataaaacagtttccataaggtgtcagcaacagcactaaaaatctcaaatcacactgaaccctaaatgtcattgcaagaaataaaaatttaagaattaaattgctgccctgtgtataatctcttgagatctttttaaagctagcaagaactctatttggatcagaactacattattacaaaacaaaatgaacacttgaccaaaaaaccacattaatttaaatggagcctttcattattttcagatagcggggtcttttccatttatagagaatgatgtaactgccaggacacttttgtgtttgcccaggactcctagtaagaattgaatcttgagggagtaatgataacaaaaggtttcttgtgactggtaacatcaggacagacagagtttttggtgagaagaaagtactatatgcctgcttgatagcatgtagagatcatcacatgtatggaaaccttaaaaagtaaacttattttttctaactagaaggctctcataagtttctgttatgattgccatttcaataaatgacattaaaaatctaaaggatattattgtttgaatttttgggttattttttaaaacttcattgctgtttttgacagcatttgtgactgtcattgccactaaattattgagctagaagatgctgcagggaaaattgttttgaagctggcatctaagcattcttttttttttcctagttgatgccttcctttattacaaatcagtattaaaacttccagattatattcttgtcatttttcctcatgcagataacagcaggaaggacttaaggtgtataagaaaaagaaagtattcatacagaaattacctagcagttgtgccctcagagtagaactttgaaacaggactgaagccctttttacctagaaccatttaaaagcctgagcaaggaccaccaccccctccccaccaaattattcggtctctttctggggggcccagcttactgtatgttacaagtctttgaaatgggtctggtgtcttcagctcctgaaatgctaatttaccccttacctaaggagtgtagttataatacagagttggtttccttccttccttccttccttccttccttccttccttccttccttccttccttccttccttccttcattccctctgtccgtctctccttccctccttccctccttccttcctttttgtctttgtttctttctctggccccctgtcctctctctctgtctcatccccttttcccactttccttctgtctctccttcctcccttcctttacagtttaaaaaaaaaatctaaaaatagttaagcactgtgtcaaagagtgtttcaaaagaattgtttgttttctcatttcttaaaccagaagtttatgacaaataaatatgccatgtaatatgaaagctgcttcagctttttatgagctttcacattccttgtttgtccttttaatttgtttcttgatatatgaagactataaacttgaaacaaagagttagctgtcagctcttgataatataattggggaaacagaatagatattttatgatatgataattctgatgatctaaagataatgtcttagacaattacctttacatttcaagctctgggatataaattacgtagtcagcattaagatagtattatttttaattgctactaagtggtaacttttgtattttaatatcttgcaagggcaaagaaggcatttttaaaattctaaatgcacacctcctaaggtaaatagtctttcaaaaatatcaggcgtgccaactcttgctgagttttgttaaatcctccttaactgtctgcagtgccccctgacttcttttaaatggatgtgaatatatgtggaaaactaaatccatttattataaatgccttatctttaccctttgggatcttactaaatgcattttacctgctactatttattaaaaatggaagctgtcttgaattagagatacctcacgtaaggtaggttaagcagtcaagtatttctttaggcttatgttcagcacctcagccccctactgagaagttaattaattcagtccaaaatgaaattatagggcagtttggtgcaatttatgttaaatgccatttgaatgtaatcacctgtgttaccacgaatgaggcacaactatactacatggacagagtactgcattgcaccatgagcaagaactgctctgcaagaaaaatatctgtccctgtggtctgaatttatcaaaactcattttcttgttaaagagtgaattattgaatagtaattaaactttaactgatgaccatttatattctagtagccatcttcactgttagtcttaaattataatgtaaagttgacattttccccttacatttcaaaggcatcactatttttaaatgtttacatatgtttacatgtttgtgtgcaactgcttcattgctattaatagttaaatgaaatctgcatattctggatcatagatgttcttagttaactctgggaaagatgttacctttgggtttttaaaagacaagtcatcatttgaaaatatattagggtgtgttgattttctgacatgcttgtgtaattggctttgtttataatttttattttttaatatgggtcagacttttggattaaaaagtattatatcatggacatacattttttaaagtaccaaaggtatttggtaagcgagcccaagtcatgtaattgaaacttctgtacattaaaagaactgattcatgaagacgttttctaactttttctctttaagtgctcctctagactagactgattgaagtagacagtgtggtggaatcagtttaatcagaaaaagacataccaagtagctggtgctaattattataagactaacattctgataagccatggtataattaacattattaaaatgtttacatataatccttcttaaagtatactcttttaaaaatccattgacataaccttacttttagtttagtgatccagaatttccccagagcttaagccactgcagtaaattaggtacgtaggatattcagtcgctactagccacaaggagtctccttattttaatgtacctccctcagtactttattcctgcagagcgcctcagagtgggggagagaaatgagcaatcctggctcagttggattatttcagcattttatttctaaatctgtagtgtgatcagaaatatttaaaattaaaaaaatactttacagagagaggcctactaatcaatgtgcttagagaaacaaactacctttacattcaattaacaacaaaaaaagttacagaaattttaacaaacatttttctttatctgagtatgggagaaaatactaatgctgacacgtttaataattagaaaagatcattccagatcttatggaaaattgtgttttaaattccagcagtttgctcttgagacatggtaatctcttaatgtaactactaaaggagaggtagattgaaaagatcttgtatatacataattatgtcagatggttcaagatatcaaaataaattgttttgttgaaaatgaaaaaaaaaaaaaaaaaaaa

SEQ ID NO: 4 - protein, 609 aa, Homo sapiens
MEGPSLRGPALRLAGLPTQQDCNIQEKIDLEIRMREGIWKLLSLSTQKDQVLHAVKNLMVCNARLMAYTSELQKLEEQIANQTGRCDVKFESKERTACKGKIAISDIRIPLMWKDSDHFSNKERSRRYAIFCLFKMGANVFDTDVVNVDKTITDICFENVTIFNEAGPDFQIKVEVYSCCTEESSITNTPKKLAKKLKTSISKATGKKISSVLQEEDDEMCLLLSSAVFGVKYNLLAHTTLTLESAEDSFKTHNLSINGNEESSFWLPLYGNMCCRLVAQPACMAEDAFAGFLNQQQMVEGLISWRRLYCVLRGGKLYCFYSPEEIEAKVEPALVVPINKETRIRAMDKDAKKRIHNFSVINPVPGQAITQIFAVDNREDLQKWMEAFWQHFFDLSQWKHCCEELMKIEIMSPRKPPLFLTKEATSVYHDMSIDSPMKLESLTDIIQKKIEETNGQFLIGQHEESLPPPWATLFDGNHQMVIQKKVLYPASEPLHDEKGKKRQAPLPPSDKLPFSLKSQSNTDQLVKDNWGKTSVSQTSSLDTKLSTLMHHLQKPMAAPRKLLPARRNRLSDGEHTDTKTNFEAKPVPAPRQKSIKDILDPRSWLQAQV

SEQ ID NO: 5 - DNA, 2123 bp, Homo sapiens
  CDS (98)..(589)
ccgggcggttggcgtcctctgcggctcctgccaggggcgggcttttcaaatcttccctttgaaggagtggcgacggcccggacagttcgcgttggagatggaggggccgagcctgaggggtcctgcgctccgcctggcggggcttcccacccagcaggactgcaacattcaagaaaaaatagacttagaaattcgaatgcgagaaggaatatggaaactcctttctctgagcactcagaaagatcaagttttacatgcagttaagaatctcatggtgtgcaatgctcgactaatggcctatacatcggagctacagaaattagaagaacagattgcaaatcagactggaagatgtgatgtgaaatttgaaagtaaagaacgaacagcatgtaaaggaaagattgccatatcagatattcgaataccactaatgtggaaagactctgatcacttcagcaataaagaacgatcacgacgctatgccattttttgtttattcaaaatgggagctaatgtgtttgatactgatgtggtgaatgtggataaaacaatcacagatatatgttttgaaaatgtaaccatattgtaagtattttttaatcttcagagaataaaaataatttaaaattcttcttttttaaaagaaagttcttattattggttctttggattcattttatgtttaaatgtttaagtgatctttaaatgtttaatatgattttaaaaattattttgttcagaagaagtccatttctctatctgcagttttctgatgtgaaataaaaatggaaatcttgtaattactattagcagtaaatatttgacttattagatatgacccatttttaaattgttaataaatatagttcagttattaacaaagctatgcatacaacagaatatcctgtaatgttatttgatatagagagaatttaagcataaaacaggatttttatctcatgtaggatatttggttgcagaaatactaaaatagtatagcaactttatttacaagatagtcctgaagtacatgctatataggaagagcactttgaaattttggggtgttctttttcttatggtgcacttctttcatgtacttcaaagcaataaaaaaaaatgggtgatctcagggctgtttttattgtccctgctcttttacaggctcattttattgtggtcataatacagaacaagaaggaactccttgggtagccatagaaatcatttttaactaacatagtttttcctgccctccttcaaaggttctatgtgcctaaatcagtgtgggatttgtattttagacttttaaagacacgatctttagatctaaatgttaatagctactaactattaatataaaaatccatgtgcatggtttttgccattttcagctatggagctagacaggtgagattttagaggcctagttttgccactcacataacattaaaaaaacctataacaaaccatattttgtagcttctggtccagtgtctcatagtaatagtatagcctggaaaaataaaatgcattgttctgagttataagtagtaattcaggccttcttacaagctgtattgaaccaaaggaatttatttaggatccaaaacatatccccaaatgcttatataattgaggctaaaaaaattacttttttcttggttatctgaatacatttatttccattatcaactattgctagtgaacttttttttctgccaaaattaccagttgatgggcccttttcttcacatcattttgctattgtttgttttgatcatggagacaaaaatcagacttttttttccagggaaagaacaatagaagttactgaggaagacaacacatgatttataattttttgagaattctgtaaatattttaaattgtactaaaaataactgctgacaaatgttctacatgttgaaaaatgtgctttttgttatgatgattgtttttaataagtattcaatatttatgaatctctggtttttctctaaatattgacatttgttagtcattaccaggaatactgcatgtttaaaagttgccaaataataaactataaaaataaaaaaaaaaaaaaaaaaaaaaaaaaaaaaaaaaaaaaaaaaaaaaaa

SEQ ID NO: 6 - protein, 163 aa, Homo sapiens
MEGPSLRGPALRLAGLPTQQDCNIQEKIDLEIRMREGIWKLLSLSTQKDQVLHAVKNLMVCNARLMAYTSELQKLEEQIANQTGRCDVKFESKERTACKGKIAISDIRIPLMWKDSDHFSNKERSRRYAIFCLFKMGANVFDTDVVNVDKTITDICFENVTIL

SEQ ID NO: 7 - DNA, 2592 bp, Homo sapiens
  CDS (10)..(810)
ggctgcaccatgcacgtgaacggcaaagtggcgctggtgaccggcgcggctcagggcataggcagagcctttgcagaggcgctgctgcttaagggcgccaaggtagcgctggtggattggaatcttgaagcaggtgtacagtgtaaagctgccctggatgagcagtttgaacctcagaagactctgttcatccagtgcgatgtggctgaccagcaacaactgagagacacttttagaaaagttgtagaccactttggaagactggacattttggtcaataatgctggagtgaataatgagaaaaactgggaaaaaactctgcaaattaatttggtttctgttatcagtggaacctatcttggtttggattacatgagtaagcaaaatggaggtgaaggcggcatcattatcaatatgtcatctttagcaggactcatgcccgttgcacagcagccggtttattgtgcttcaaagcatggcatagttggattcacacgctcagcagcgttggctgctaatcttatgaacagtggtgtgagactgaatgccatttgtccaggctttgttaacacagccatccttgaatcaattgaaaaagaagaaaacatgggacaatatatagaatataaggatcatatcaaggatatgattaaatactatggaattttggacccaccattgattgccaatggattgataacactcattgaagatgatgctttaaatggtgctattatgaagatcacaacttctaagggaattcattttcaagactatgatacaactccatttcaagcaaaaacccaatgaacagcttatgtgttagccatagctgaaaataagcacaaatagcttatattcagatcctatcttcatttgaatatagcttttaaatgaaatgttacagtttgaagttttccttcatgcacttggtgataaacgttttctaaatttttagttaagtatatggataaaaagttatgaactattaaaaatgtgatgtggaccaaaggctaggttgtaatcttgatagtctaaaaaatgatcaaaacaaatgattttcaaggaatattcaatattctgcctttcagaaagtgtatttatatctgtgcttcataaatattaatgttcttcagaacatcattttaaaggagatacttgaattgttatttaaatcaaaccagatgtaaaacactcacatacaagttcatactttaaaagaggaaagctacttaacaatgacaaatatttcacaataataatttttacttatataccatctttcaactgaacatttcagttcttccaagagcttcttagagtagtatattttgggggcagtcaaggaataaactacagtgtaaacatatcccagatgaaaactgctgtatggaaaaatgacagaaagtaactgattgacactgttgattcacagttcagcctcctatctgggaaagacatttctttcctctgctcactttaagaacttttaccgactccaaaaatctcaggaattaaacttttaacagttacagcaataaagaatagttagtactccaaaaatattatatttaagatgctcaacaagaaaaaaatgcaaatgtaatatttttttcaaattacttctttattgacttgtccaaatttcaaaagtgcctacccttcaataaaacttttttattctgatctccataaattacttagtcttctatgtatagctatcaaggaaataaaaccaattttgccacagccacaactgtaaatgtttttgtacccatgctgaaactcataacaacacagacataaaaatagctgtgaggttttgctttttttgttgtcagctatcttaagaatcattaaatacacctgctttgggtaaaactctttgcaagcagtaattaacactagtaacagtgaaagcacaagatttccaaatcagtcgttttctcaaaaaaatatcgtataagtgactcatcctgtctgctaactccagacctcccagcttgaagccaaatctttccatgtgagattgatatggatttcctagaagtactggaatgttgtcatatcttgccctattttaattctgctatagaaaacaattgccttcacttttaaggagtaatttgaatattaataactctggtctagattttcatataatgtattaaagacaaagtagtgaacatcaatgaacatctgatagagataaactgtaatcaggcataagcttgtttgtatgttctggcagtgactaatcagtaaatgatgtcggtttgcccagtatcacttatcttctgtatttttcctctgtcgtgtaaatagtataaccttttcatttatggacaattttttggactagtagccttcaatatacattctgctttgaattaattttttcaaatcaataaattatgtagacatttaaaatcaaatatcaagtagaattgaaaaatgtgagttacataagttaaaaacttactttaaatcttaccttctataggtagctctaaataaattcatatggttatatggcaaaaaaaaaaaaaaaaaaaaaaaaaaaaaaaaaaaaaaaaaaaaaaaaaaaaaaaa

SEQ ID NO: 8 - protein, 266 aa, Homo sapiens [sequence omitted]

SEQ ID NO: 9 - DNA, 2355 bp, Homo sapiens
  CDS (161)..(1837)
gcagaggaggcggcggaacaccccgggttggtcgggtttccaagggctgacccgagctccagcactttttccgcgcctgatttttcagagctcttcagaaaccaggctgctttcaggaacattgctgtggattcccagggcctattccactagaagcaagatggctgaactcaatactcatgtgaatgtcaaggaaaagatctatgcagttagatcagttgttcccaacaaaagcaataatgaaatagtcctggtgctccaacagtttgattttaatgtggataaagccgtgcaagcctttgtggatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacagaaggcaacagactactgcaacagaaactatccttagatgggaaccccaaacctatacatggaacaacagagaggtcagatggcctacagtggtcagctgagcagccttgtaacccaagcaagcctaaggcaaaaacatctcctgttaagtccaatacccctgcagctcatcttgaaataaagccagatgagttggcaaagaaaagaggcccaaatattgagaaatcagtgaaggatttgcaacgctgcaccgtttctctaactagatatcgcgtcatgattaaggaagaagtggatagttccgtgaagaagatcaaagctgcctttgctgaattacacaactgcatcattgacaaagaagtttcattaatggcagaaatggataaagttaaagaagaagccatggaaatcctgactgctcgtcagaagaaagcagaagaactaaagagactcactaaccttgccagtcagatggcagagatgcagctggccgaactcagggcagaaattaagcactttgtcagcgagcgtaaatatgacgaggagctcgggaaagctgcccggttttcctgtgacatcgaacagctgaaggcccaaatcatgctctgcggagaaattacacatccaaagaacaactattcctcaagaactccctgcagctccctgctgcctctgctgaatgcgcacgcagcaacctctgggaaacagagtaacttttcccgaaaatcatccactcacaataagccctctgaaggcaaagcggcaaaccccaaaatggtgagcagtctccccagcaccgccgacccctctcaccagaccatgccggccaacaagcagaatggatcttctaaccaaagacggagatttaatccacagtatcataacaacaggctaaatgggcctgccaagtcgcagggcagtgggaatgaagccgagccactgggaaagggcaacagccgccacgaacacagaagacagccgcacaacggcttccggcccaaaaacaaaggcggtgccaaaaatcaagaggcttccttggggatgaagacccccgaggccccggcccattctgaaaagccccggcgaaggcagcacgctgcagacacctcggaggccaggcccttccggggtagtgtcggtagggtttcacagtgcaatctctgccccacgagaatagaagtttccacagatgcagcagttctctcagtcccggctgtgacgttggtggcctgagctaggaggaaaaagagcagttttcactcagttttggttccctgcccgaggtgctgacccaattcgctgccaaaagagtgtcaatcagaatatacaaatcccgtatggttgtgtcatcctctcttaatcatttttactaattctaataatcagctctagcttgcttcataattttcatggctttgcttgatctgttgatgctttctctcatcaagactttgcagcattttagccaggcagtatttactcattattaggaaaatcaagatgtggctgaagatcagaggctcagttagcaacctgtgttgtagcagtgatgtcagtccatagattgtctttagagagttaatgttacaaaaaagaattcttaataatcagacaaacatgatctgctgaggacacatgcgcttttgtagaatttaacatctggtgtttttctgaaaaaatatatatacatatattgctttatttgaaacaaattaaaatatgctgcatttgaaaaaaaaaaaaaaaaaaaa

SEQ ID NO: 10 - protein, 558 aa, Homo sapiens
MAELNTHVNVKEKIYAVRSVVPNKSNNEIVLVLQQFDFNVDKAVQAFVDGSAIQVLKEWNMTGKKKNNKRKRSKSKQHQGNKDAKDKVERPEAGPLQPQPPQIQNGPMNGCEKDSSSTDSANEKPALIPREKKISILEEPSKALRGVTEGNRLLQQKLSLDGNPKPIHGTTERSDGLQWSAEQPCNPSKPKAKTSPVKSNTPAAHLEIKPDELAKKRGPNIEKSVKDLQRCTVSLTRYRVMIKEEVDSSVKKIKAAFAELHNCIIDKEVSLMAEMDKVKEEAMEILTARQKKAEELKRLTNLASQMAEMQLAELRAEIKHFVSERKYDEELGKAARFSCDIEQLKAQIMLCGEITHPKNNYSSRTPCSSLLPLLNAHAATSGKQSNFSRKSSTHNKPSEGKAANPKMVSSLPSTADPSHQTMPANKQNGSSNQRRRFNPQYHNNRLNGPAKSQGSGNEAEPLGKGNSRHEHRRQPHNGFRPKNKGGAKNQEASLGMKTPEAPAHSEKPRRRQHAADTSEARPFRGSVGRVSQCNLCPTRIEVSTDAAVLSVPAVTLVA

SEQ ID NO: 11 - DNA, 1054 bp, Homo sapiens
  CDS (293)..(790)
attcaagcctgggccctggaaggaggggtggacagtcccctcccttccagtccagcatgggtctggggaagaggagcagctttgcctggaaggggcctcctaggagggggagcggtggtttctagctcaggctttaggatcagagagcagcagattcaaatcctgacggttttggtaaagtcaattcaatctctccaagactccgtttacttgatctgcgaagtggggataatggtatcacgtcgcagggttgtcaggcggagctggtaggggagctgccccccagagcagcatggatgccccgcgaagggacatggagttgctcagcaacagcctggctgcctacgcgcacatccgcgccaaccccgagagctttggcctctacttcgtgctgggcgtctgcttcggcctgctgctcaccctctgcctgctcgtcatcagcatctcgtgggcgccccgcccgcggccccggggcccggctcagcgccgggacccccgcagcagcaccctggagcccgaggacgacgacgaggacgaggaggacacggtgactcggctgggccccgacgacacgctgccgggccccgagctgtccgcagagccggacgggcccctcaacgtcaacgtcttcacgtcggcggaggagctggagcgggcgcagcggctggaggagcgcgaacggatcctgcgggagatctggcgcaccgggcagccggacctgctgggcacaggcacgctggggcccagccccacggccacgggcaccctgggccgcatgcactattactgatgggccctggctcccgccgcaaggcgctcggggtaccggacctgtacatgagctcagagctaccccacaccttcggactgcctcggcccccacagctcccaggtgctactgggcgtggaccgccaccccctgagaggctcccttccccagtcctgccagaagaccccgggggcggggagggggcagcatgcagggtccccactccctctctggggtcgatgaagaggtgaagtgaccaaatgaaagaaagctgcattctcagtg

SEQ ID NO: 12 - protein, 165 aa, Homo sapiens
MDAPRRDMELLSNSLAAYAHIRANPESFGLYFVLGVCFGLLLTLCLLVISISWAPRPRPRGPAQRRDPRSSTLEPEDDDEDEEDTVTRLGPDDTLPGPELSAEPDGPLNVNVFTSAEELERAQRLEERERILREIWRTGQPDLLGTGTLGPSPTATGTLGRMHYY

SEQ ID NO: 13 - DNA, 2213 bp, Homo sapiens
  CDS (1422)..(1799)
tttgagccactgcatcccctagcggcgcccgggtggctgcagccgctggcccgaaaatgctgctcgggcgagcaggggtcaggcgggaaaagaagactccaaatccactctctgctcgcccccagggcaatgctgccaggagagggagtgggttcccccgcaggctatcccaccgatggggctgagagcttaatttggggttttatttgaattggagacattgttccctcttcgctcctctaccccataaaattccctacaaatgcaaaaattcgagatagaagaagccgtccctgaaagtaagttctgaaggattcctttcatgcggtgaaggaacaacaacaatattcaacttcaccttggtgtgtgagggtcgtcgtgttttaaaacactatccctgtagaaagattagtgaaatgtattggaagaagtagtggaaacgtgaatcttcctggtctcgcgtttggatcttctttggagtcctcaccttcttaaatctgatgtttgtttgaaatcagggctgaatttccatatataggacagaaagaaagaaccccaattttttaaagaaagctcccccccccccgccacgtttctcctgagcccacttggtctcccgttattaggcggcccagttaagaggcatcgattttcctttcattctctgaccactcgtctctcctgggccagccaggctgcccgcatcttctcctgctcacagcgctctctaaaccttttaattatttagttgctgtctaacattcaccggaaacctctccataaacaaggagaaacgaatgcacacgcatttttgctaagaagcccgggattaagatttaaggatacaagctgaaagaaaaaatgaaaaatgcttctccgcgcgtcaatcgaggggtggatgcgccacgcagcgtgagcccagctcacagccacgcgtaagaccaaaagctgccatgggttctgcgcgcggagacctcagagccgaagagagaagtccccgcgtcagaaacgctgcggatgccaggtcttgaaaatgctgacttctgaggctaagaattatttcaaagacaaaaagaaaagactggagcagccggcggagctcgggtggaggaaagcgaggaggcgaccaggaggatgccgccgccgccgccgcagggcccggggcttctgcagggcgcaaggcctccctcaccagggtaaggggctggcgatcaacctggacgcctgggaccttgggagcaagcatcccgcagccgagcaggcgacggcgcggccaccgcctagagaggagccggggcccggggcggcgtgcgggtcggcagcagccggcttggcctatccgaaaccccaggcctggaagcggctgctttaggcgtcaagttgagcggggtatgtgtgtcctcttggaaaaaaggtgagaaatggagccggactttctccactcggtaggggttaagctaccacacacacccccaaacacatgcccacgtgcaagtccctcccacccgccctcccaggggcgaagagaccctgtcccagtggaagtggggaaacccagtcgggtacagaaagcagaggccatggcgcagagcggaggcgcggctttctggggctcagccctagggctacagacccagggcgcggagatgctcgcggccgggccacccaccagagccaggcaaccggcgcttccaggcgagctccgcggggccgaggtgccgggagaagcggccccgggcgcccgcgcgctgcccgacctgggtaacaggcaaagcggagccccggggtcgaagtcctaaagttactaatcccgcggagggggagagagcgtgcctcgggccgcccggggcggtcatttgagcgtgtttacttaaagactttgcaagcagagcgcgcgcgaaatcgtcggatttccagcgaggcagcaaatatttgcaggcagaagaaagaagcggagccgagccgagccgccgagtccctccccccggagccccggagccccggcgcctgcctgggcggtcccggccgcgcagacagaaaagaagccgggaatctgcggggctggggggcggggagcgacaccaaaggccagaaactgcagcacggcccgaggccctggcgagctgggcctgggggaggagaagtcccttcccattccagctcgatcaatcttgctgggctgcgatcggtcaataaaaacggtgtgaagcggc

SEQ ID NO: 14 - protein, 125 aa, Homo sapiens
MEPDFLHSVGVKLPHTPPNTCPRASPSHPPSQGRRDPVPVEVGKPSRVQKAEAMAQSGGAAFWGSALGLQTQGAEMLAAGPPTRARQPALPGELRGAEVPGEAAPGARALPDLGNRQSGAPGSKS

SEQ ID NO: 15 - DNA, 1330 bp, Homo sapiens
  CDS (48)..(1181)
gcagcccagccaagcactgtcaggaatcctgtgaagcagctccagctatgtgtgaagaagaggacagcactgccttggtgtgtgacaatggctctgggctctgtaaggccggctttgctggggacgatgctcccagggctgttttcccatccattgtgggacgtcccagacatcagggggtgatggtgggaatgggacaaaaagacagctacgtgggtgacgaagcacagagcaaaagaggaatcctgaccctgaagtacccgatagaacatggcatcatcaccaactgggacgacatggaaaagatctggcaccactctttctacaatgagcttcgtgttgcccctgaagagcatcccaccctgctcacggaggcacccctgaaccccaaggccaaccgggagaaaatgactcaaattatgtttgagactttcaatgtcccagccatgtatgtggctatccaggcggtgctgtctctctatgcctctggacgcacaactggcatcgtgctggactctggagatggtgtcacccacaatgtccccatctatgagggctatgccttgccccatgccatcatgcgtctggatctggctggccgagatctcactgactacctcatgaagatcctgactgagcgtggctattccttcgttactactgctgagcgtgagattgtccgggacatcaaggagaaactgtgttatgtagctctggactttgaaaatgagatggccactgccgcatcctcatcctcccttgagaagagttacgagttgcctgatgggcaagtgatcaccatcggaaatgaacgtttccgctgcccagagaccctgttccagccatccttcatcgggatggagtctgctggcatccatgaaaccacctacaacagcatcatgaagtgtgatattgacatcaggaaggacctctatgctaacaatgtcctatcagggggcaccactatgtaccctggcattgccgaccgaatgcagaaggagatcacggccctagcacccagcaccatgaagatcaagatcattgcccctccggagcgcaaatactctgtctggatcggtggctccatcctggcctctctgtccaccttccagcagatgtggatcagcaaacaggaatacgatgaagccgggccttccattgtccaccgcaaatgcttctaaaacactttcctgctcctctctgtctctagcacacaactgtgaatgtcctgtggaattatgccttcagttcttttccaaatcattcctagccaaagctctgactcgttacctatgtgttttttaataaatctgaaataggctactggtaa

SEQ ID NO: 16 - protein, 377 aa, Homo sapiens
MCEEEDSTALVCDNGSGLCKAGFAGDDAPRAVFPSIVGRPRHQGVMVGMGQKDSYVGDEAQSKRGILTLKYPIEHGIITNWDDMEKIWHHSFYNELRVAPEEHPTLLTEAPLNPKANREKMTQIMFETFNVPAMYVAIQAVLSLYASGRTTGIVLDSGDGVTHNVPIYEGYALPHAIMRLDLAGRDLTDYLMKILTERGYSFVTTAEREIVRDIKEKLCYVALDFENEMATAASSSSLEKSYELPDGQVITIGNERFRCPETLFQPSFIGMESAGIHETTYNSIMKCDIDIRKDLYANNVLSGGTTMYPGIADRMQKEITALAPSTMKIKIIAPPERKYSVWIGGSILASLSTFQQMWISKQEYDEAGPSIVHRKCF

SEQ ID NO: 17 - DNA, 1644 bp, Homo sapiens
  CDS (139)..(1386)
agacagcagacaaagcagccccagggataggggagattccagagaggcccgtgaccaggccacagggatgctggggctgtaaaccaaaagccactggactctgtaaacccactgggcaccacagaggcagaaggggtgatgagtgagaggcgagtggtagtggacttgcccaccagtgccagctccagcatgcccctccagaggcgcagggcgtccttcagggggccacggtcatcatcctccctggagagccccccagcctccaggaccaatgccatgagtggccttgtccgagcacccggggtctatgtaggaacagcacccagtgggtgcataggtggcttgggtgcccgtgtgacccgccgggccctcggcatcagcagtgtcttccttcagggcctgcggagctcaggcctggccaccgtgccggctccaggtttggagagggaccatggtgctgttgaggacctagggggctgcctggtggaatatatggccaaagtgcacgcccttgagcaagtcagtcaggagctggaaacacaactgcggatgcacctggagagcaaagccacacgctcgggaaactggggtgccctacgggcttcctgggccagcagctgccagcaggtgggtgaggcagtcttggaaaatgcccggctcatgctgcagacagaaactatccaggccggagcagatgactttaaagagagatatgaaaatgagcagccatttcgaaaggcagcagaagaggaaattaactctctgtataaagtcattgatgaggctaatttgactaaaatggacctggagagtcaaatagaaagtctgaaagaagaacttggctctctatcaagaaactatgaagaggatgtgaagctgctgcacaaacagttggcagggtgtgagctggaacaaatggatgctcccattggcactggtctggacgacatccttgagacgatcagaattcagtgggagagagatgttgaaaagaaccgggtggaggcaggagccctgctccaagctaagcaacaggcggaggtggcccacatgtcccagacccaggaggagaagctggcagctgccctcagggtggagttacacaacacttcgtgccaagtccagagcctccaggctgagacagaatccttacgtgccctgaaacgaggcctggagaacaccttgcacgatgccaagcactggcatgacatggagctccagaacctgggcgctgtggtcggccggctggaggcggagctcagggaaatccgagcggaggcggagcagcagcaacaggagcgcgcgcatctgctggcccgcaagtgccagctgcagaaggacgtggcgtcctaccacgccctgctggacagggaggagagcggctgatggagaaacttcctctttttcatgaagaaaacacccttcctcaacagctgacccaagaagttgcttgaggagctttctcctgagctccagtccctgctggattccctggttaattcagcttgagctgaaaagcttcctggaagtggagaggatccttctgctttaatctgagtagtctgtagcttgagcaatctcccttgtcctccttcaaataaatgctttgtgcgcagcgtccagtttaaaaaaaaaaaaaaaaaa

SEQ ID NO: 18 - protein, 415 aa, Homo sapiens
MSERRVVVDLPTSASSSMPLQRRRASFRGPRSSSSLESPPASRTNAMSGLVRAPGVYVGTAPSGCIGGLGARVTRRALGISSVFLQGLRSSGLATVPAPGLERDHGAVEDLGGCLVEYMAKVHALEQVSQELETQLRMHLESKATRSGNWGALRASWASSCQQVGEAVLENARLMLQTETIQAGADDFKERYENEQPFRKAAEEEINSLYKVIDEANLTKMDLESQIESLKEELGSLSRNYEEDVKLLHKQLAGCELEQMDAPIGTGLDDILETIRIQWERDVEKNRVEAGALLQAKQQAEVAHMSQTQEEKLAAALRVELHNTSCQVQSLQAETESLRALKRGLENTLHDAKHWHDMELQNLGAVVGRLEAELREIRAEAEQQQQERAHLLARKCQLQKDVASYHALLDREESG

SEQ ID NO: 19 - DNA, 1237 bp, Homo sapiens
  CDS (69)..(344)
gctgcagaggattcctgcagaggatcaagacagcacgtggacctcgcacagcctctcccacaggtaccatgaaggtctccgcggcagccctcgctgtcatcctcattgctactgccctctgcgctcctgcatctgcctccccatattcctcggacaccacaccctgctgctttgcctacattgcccgcccactgccccgtgcccacatcaaggagtatttctacaccagtggcaagtgctccaacccagcagtcgtctttgtcacccgaaagaaccgccaagtgtgtgccaacccagagaagaaatgggttcgggagtacatcaactctttggagatgagctaggatggagagtccttgaacctgaacttacacaaatttgcctgtttctgcttgctcttgtcctagcttgggaggcttcccctcactatcctaccccacccgctccttgaagggcccagattctaccacacagcagcagttacaaaaaccttccccaggctggacgtggtggctcacgcctgtaatcccagcactttgggaggccaaggtgggtggatcacttgaggtcaggagttcgagaccagcctggccaacatgatgaaaccccatctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaatacaaaaattagccgggcgtggtggcccacgcctgtaatcccagctactcgggaggctaaggcaggaaaattgtttgaacccaggaggtggaggctgcagtgagctgagattgtgccacttcactccagcctgggtgacaaagtgagactccgtcacaacaacaacaacaaaaagcttccccaactaaagcctagaagagcttctgaggcgctgctttgtcaaaaggaagtctctaggttctgagctctggctttgccttggctttgccagggctctgtgaccaggaaggaagtcagcatgcctctagaggcaaggaggggaggaacactgcactcttaagcttccgccgtctcaacccctcacaggagcttactggcaaacatgaaaaatcggcttaccattaaagttctcaatgcaaccataaaaaaaaaa

SEQ ID NO: 20 - protein, 91 aa, Homo sapiens
MKVSAAALAVILIATALCAPASASPYSSDTTPCCFAYIARPLPRAHIKEYFYTSGKCSNPAVVFVTRKNRQVCANPEKKWVREYINSLEMS

SEQ ID NO: 21 - DNA, 2188 bp, Homo sapiens
  CDS (64)..(1200)
agacaggggtagtgcgaggccgggcacagccttcctgtgtggttttaccgcccagagagcgtcatggacctggggaaaccaatgaaaagcgtgctggtggtggctctccttgtcattttccaggtatgcctgtgtcaagatgaggtcacggacgattacatcggagacaacaccacagtggactacactttgttcgagtctttgtgctccaagaaggacgtgcggaactttaaagcctggttcctccctatcatgtactccatcatttgtttcgtgggcctactgggcaatgggctggtcgtgttgacctatatctatttcaagaggctcaagaccatgaccgatacctacctgctcaacctggcggtggcagacatcctcttcctcctgacccttcccttctgggcctacagcgcggccaagtcctgggtcttcggtgtccacttttgcaagctcatctttgccatctacaagatgagcttcttcagtggcatgctcctacttctttgcatcagcattgaccgctacgtggccatcgtccaggctgtctcagctcaccgccaccgtgcccgcgtccttctcatcagcaagctgtcctgtgtgggcatctggatactagccacagtgctctccatcccagagctcctgtacagtgacctccagaggagcagcagtgagcaagcgatgcgatgctctctcatcacagagcatgtggaggcctttatcaccatccaggtggcccagatggtgatcggctttctggtccccctgctggccatgagcttctgttaccttgtcatcatccgcaccctgctccaggcacgcaactttgagcgcaacaaggccatcaaggtgatcatcgctgtggtcgtggtcttcatagtcttccagctgccctacaatggggtggtcctggcccagacggtggccaacttcaacatcaccagtagcacctgtgagctcagtaagcaactcaacatcgcctacgacgtcacctacagcctggcctgcgtccgctgctgcgtcaaccctttcttgtacgccttcatcggcgtcaagttccgcaacgatctcttcaagctcttcaaggacctgggctgcctcagccaggagcagctccggcagtggtcttcctgtcggcacatccggcgctcctccatgagtgtggaggccgagaccaccaccaccttctccccataggcgactcttctgcctggactagagggacctctcccagggtccctggggtggggatagggagcagatgcaatgactcaggacatccccccgccaaaagctgctcagggaaaagcagctctcccctcagagtgcaagcccctgctccagaagatagcttcaccccaatcccagctacctcaaccaatgccaaaaaaagacagggctgataagctaacaccagacagacaacactgggaaacagaggctattgtcccctaaaccaaaaactgaaagtgaaagtccagaaactgttcccacctgctggagtgaaggggccaaggagggtgagtgcaaggggcgtgggagtggcctgaagagtcctctgaatgaaccttctggcctcccacagactcaaatgctcagaccagctcttccgaaaaccaggccttatctccaagaccagagatagtggggagacttcttggcttggtgaggaaaagcggacatcagctggtcaaacaaactctctgaacccctccctccatcgttttcttcactgtcctccaagccagcgggaatggcagctgccacgccgccctaaaagcacactcatcccctcacttgccgcgtcgccctcccaggctctcaacaggggagagtgtggtgtttcctgcaggccaggccagctgcctccgcgtgatcaaagccacactctgggctccagagtggggatgacatgcactcagctcttggctccactgggatgggaggagaggacaagggaaatgtcaggggcggggagggtgacagtggccgcccaaggcccacgagcttgttctttgttctttgtcacagggactgaaaacctctcctcatgttctgctttcgattcgttaagagagcaacattttacccacacacagataaagttttcccttgaggaaacaacagctttaaaagaaaaagaaaaaaaaagtctttggtaaatggcaaaaaaaaaaaaaaaaaa

SEQ ID NO: 22 - protein, 378 aa, Homo sapiens
MDLGKPMKSVLVVALLVIFQVCLCQDEVTDDYIGDNTTVDYTLFESLCSKKDVRNFKAWFLPIMYSIICFVGLLGNGLVVLTYIYFKRLKTMTDTYLLNLAVADILFLLTLPFWAYSAAKSWVFGVHFCKLIFAIYKMSFFSGMLLLLCISIDRYVAIVQAVSAHRHRARVLLISKLSCVGIWILATVLSIPELLYSDLQRSSSEQAMRCSLITEHVEAFITIQVAQMVIGFLVPLLAMSFCYLVIIRTLLQARNFERNKAIKVIIAVVVVFIVFQLPYNGVVLAQTVANFNITSSTCELSKQLNIAYDVTYSLACVRCCVNPFLYAFIGVKFRNDLFKLFKDLGCLSQEQLRQWSSCRHIRRSSMSVEAETTTTFSP

SEQ ID NO: 23 - DNA, 1834 bp, Homo sapiens
  CDS (73)..(858)
actttgacagtcttctcatgctgcctctgccaccttctctgccagaagataccatttcaactttaacacagcatgatcgaaacatacaaccaaacttctccccgatctgcggccactggactgcccatcagcatgaaaatttttatgtatttacttactgtttttcttatcacccagatgattgggtcagcactttttgctgtgtatcttcatagaaggttggacaagatagaagatgaaaggaatcttcatgaagattttgtattcatgaaaacgatacagagatgcaacacaggagaaagatccttatccttactgaactgtgaggagattaaaagccagtttgaaggctttgtgaaggatataatgttaaacaaagaggagacgaagaaagaaaacagctttgaaatgcaaaaaggtgatcagaatcctcaaattgcggcacatgtcataagtgaggccagcagtaaaacaacatctgtgttacagtgggctgaaaaaggatactacaccatgagcaacaacttggtaaccctggaaaatgggaaacagctgaccgttaaaagacaaggactctattatatctatgcccaagtcaccttctgttccaatcgggaagcttcgagtcaagctccatttatagccagcctctgcctaaagtcccccggtagattcgagagaatcttactcagagctgcaaatacccacagttccgccaaaccttgcgggcaacaatccattcacttgggaggagtatttgaattgcaaccaggtgcttcggtgtttgtcaatgtgactgatccaagccaagtgagccatggcactggcttcacgtcctttggcttactcaaactctgaacagtgtcaccttgcaggctgtggtggagctgacgctgggagtcttcataatacagcacagcggttaagcccaccccctgttaactgcctatttataaccctaggatcctccttatggagaactatttattatacactccaaggcatgtagaactgtaataagtgaattacaggtcacatgaaaccaaaacgggccctgctccataagagcttatatatctgaagcagcaaccccactgatgcagacatccagagagtcctatgaaaagacaaggccattatgcacaggttgaattctgagtaaacagcagataacttgccaagttcagttttgtttctttgcgtgcagtgtctttccatggataatgcatttgatttatcagtgaagatgcagaagggaaatggggagcctcagctcacattcagttatggttgactctgggttcctatggccttgttggagggggccaggctctagaacgtctaacacagtggagaaccgaaaccccccccccccccccgccaccctctcggacagttattcattctctttcaatctctctctctccatctctctctttcagtctctctctctcaacctctttcttccaatctctctttctcaatctctctgtttccctttgtcagtctcttccctcccccagtctctcttctcaatccccctttctaacacacacacacacacacacacacacacacacacacacacacacacacacacagagtcaggccgttgctagtcagttctcttctttccaccctgtccctatctctaccactatagatgagggtgaggagtagggagtgcagccctgagcctgcccactcctcattacgaaatgactgtatttaaaggaaatctattgtatctacctgcagtctccattgtttccagagtgaacttgtaattatcttgttatttattttttgaataataaagacctcttaacattaa

SEQ ID NO: 24 - protein, 261 aa, Homo sapiens
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTSFGLLKL

SEQ ID NO: 25 - DNA, 1988 bp, Homo sapiens
  CDS (158)..(616)
gccttctgtgtgtgcacatgtgtaatacatatctgggatcaaagctatctatataaagtccttgattctgtgtgggttcaaacacatttcaaagcttcaggatcctgaaaggttttgctctacttcctgaagacctgaacaccgctcccataaagccatggcttgccttggatttcagcggcacaaggctcagctgaacctggctaccaggacctggccctgcactctcctgttttttcttctcttcatccctgtcttctgcaaagcaatgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgatccagaaccgtgcccagattctgacttcctcctctggatccttgcagcagttagttcggggttgtttttttatagctttctcctcacagctgtttctttgagcaaaatgctaaagaaaagaagccctcttacaacaggggtctatgtgaaaatgcccccaacagagccagaatgtgaaaagcaatttcagccttattttattcccatcaattgagaaaccattatgaagaagagagtccatatttcaatttccaagagctgaggcaattctaacttttttgctatccagctatttttatttgtttgtgcatttggggggaattcatctctctttaatataaagttggatgcggaacccaaattacgtgtactacaatttaaagcaaaggagtagaaagacagagctgggatgtttctgtcacatcagctccactttcagtgaaagcatcacttgggattaatatggggatgcagcattatgatgtgggtcaaggaattaagttagggaatggcacagcccaaagaaggaaaaggcagggagcgagggagaagactatattgtacacaccttatatttacgtatgagacgtttatagccgaaatgatcttttcaagttaaattttatgccttttatttcttaaacaaatgtatgattacatcaaggcttcaaaaatactcacatggctatgttttagccagtgatgctaaaggttgtattgcatatatacatatatatatatatatatatatatatatatatatatatatatatatatatatatattttaatttgatagtattgtgcatagagccacgtatgtttttgtgtatttgttaatggtttgaatataaacactatatggcagtgtctttccaccttgggtcccagggaagttttgtggaggagctcaggacactaatacaccaggtagaacacaaggtcatttgctaactagcttggaaactggatgaggtcatagcagtgcttgattgcgtggaattgtgctgagttggtgttgacatgtgctttggggcttttacaccagttcctttcaatggtttgcaaggaagccacagctggtggtatctgagttgacttgacagaacactgtcttgaagacaatggcttactccaggagacccacaggtatgaccttctaggaagctccagttcgatgggcccaattcttacaaacatgtggttaatgccatggacagaagaaggcagcaggtggcagaatggggtgcatgaaggtttctgaaaattaacactgcttgtgtttttaactcaatattttccatgaaaatgcaacaacatgtataatatttttaattaaataaaaatctgtggtggtcgttttaaaaaaaaaaa

SEQ ID NO: 26 - protein, 153 aa, Homo sapiens
MACLGFQRHKAQLNLATRTWPCTLLFFLLFIPVFCKAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVID

SEQ ID NO: 27 - DNA, 1878 bp, Homo sapiens
  CDS (158)..(682)
gccttctgtgtgtgcacatgtgtaatacatatctgggatcaaagctatctatataaagtccttgattctgtgtgggttcaaacacatttcaaagcttcaggatcctgaaaggttttgctctacttcctgaagacctgaacaccgctcccataaagccatggcttgccttggatttcagcggcacaaggctcagctgaacctggctaccaggacctggccctgcactctcctgttttttcttctcttcatccctgtcttctgcaaagcaatgcacgtggcccagcctgctgtggtactggccagcagccgaggcatcgccagctttgtgtgtgagtatgcatctccaggcaaagccactgaggtccgggtgacagtgcttcggcaggctgacagccaggtgactgaagtctgtgcggcaacctacatgatggggaatgagttgaccttcctagatgattccatctgcacgggcacctccagtggaaatcaagtgaacctcactatccaaggactgagggccatggacacgggactctacatctgcaaggtggagctcatgtacccaccgccatactacctgggcataggcaacggaacccagatttatgtaattgctaaagaaaagaagccctcttacaacaggggtctatgtgaaaatgcccccaacagagccagaatgtgaaaagcaatttcagccttattttattcccatcaattgagaaaccattatgaagaagagagtccatatttcaatttccaagagctgaggcaattctaacttttttgctatccagctatttttatttgtttgtgcatttggggggaattcatctctctttaatataaagttggatgcggaacccaaattacgtgtactacaatttaaagcaaaggagtagaaagacagagctgggatgtttctgtcacatcagctccactttcagtgaaagcatcacttgggattaatatggggatgcagcattatgatgtgggtcaaggaattaagttagggaatggcacagcccaaagaaggaaaaggcagggagcgagggagaagactatattgtacacaccttatatttacgtatgagacgtttatagccgaaatgatcttttcaagttaaattttatgccttttatttcttaaacaaatgtatgattacatcaaggcttcaaaaatactcacatggctatgttttagccagtgatgctaaaggttgtattgcatatatacatatatatatatatatatatatatatatatatatatatatatatatatatatatattttaatttgatagtattgtgcatagagccacgtatgtttttgtgtatttgttaatggtttgaatataaacactatatggcagtgtctttccaccttgggtcccagggaagttttgtggaggagctcaggacactaatacaccaggtagaacacaaggtcatttgctaactagcttggaaactggatgaggtcatagcagtgcttgattgcgtggaattgtgctgagttggtgttgacatgtgctttggggcttttacaccagttcctttcaatggtttgcaaggaagccacagctggtggtatctgagttgacttgacagaacactgtcttgaagacaatggcttactccaggagacccacaggtatgaccttctaggaagctccagttcgatgggcccaattcttacaaacatgtggttaatgccatggacagaagaaggcagcaggtggcagaatggggtgcatgaaggtttctgaaaattaacactgcttgtgtttttaactcaatattttccatgaaaatgcaacaacatgtataatatttttaattaaataaaaatctgtggtggtcgttttaaaaaaaaaaa

SEQ ID NO: 28 - protein, 174 aa, Homo sapiens
MACLGFQRHKAQLNLATRTWPCTLLFFLLFIPVFCKAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIAKEKKPSYNRGLCENAPNRARM

SEQ ID NO: 29 - DNA, 1731 bp, Homo sapiens
  CDS (350)..(1351)
ggcggtgccggccgaacccagacccgaggttttagaagcagagtcaggcgaagctgggccagaaccgcgacctccgcaaccttgagcggcatccgtggagtgcgcctgcgcagctacgaccgcagcaggaaagcgccgccggccaggcccagctgtggccggacagggactggaagagaggacgcggtcgagtaggtgtgcaccagccctggcaacgagagcgtctaccccgaactctgctggccttgaggtggggaagccggggagggcagttgaggaccccgcggaggcgcgtgactggttgagcgggcaggccagcctccgagccgggtggacacagttttaaaacatgaatcctacactcatccttgctgccttttgcctgggaattgcctcagctactctaacatttgatcacagtttagaggcacagtggaccaagtggaaggcgatgcacaacagattatacggcatgaatgaagaaggatggaggagagcagtgtgggagaagaacatgaagatgattgaactgcacaatcaggaatacagggaagggaaacacagcttcacaatggccatgaacgcctttggagacatgaccagtgaagaattcaggcaggtgatgaatggctttcaaaaccgtaagcccaggaaggggaaagtgttccaggaacctctgttttatgaggcccccagatctgtggattggagagagaaaggctacgtgactcctgtgaagaatcagggtcagtgtggttcttgttgggcttttagtgctactggtgctcttgaaggacagatgttccggaaaactgggaggcttatctcactgagtgagcagaatctggtagactgctctgggcctcaaggcaatgaaggctgcaatggtggcctaatggattatgctttccagtatgttcaggataatggaggcctggactctgaggaatcctatccatatgaggcaacagaagaatcctgtaagtacaatcccaagtattctgttgctaatgacaccggctttgtggacatccctaagcaggagaaggccctgatgaaggcagttgcaactgtggggcccatttctgttgctattgatgcaggtcatgagtccttcctgttctataaagaaggcatttattttgagccagactgtagcagtgaagacatggatcatggtgtgctggtggttggctacggatttgaaagcacagaatcagataacaataaatattggctggtgaagaacagctggggtgaagaatggggcatgggtggctacgtaaagatggccaaagaccggagaaaccattgtggaattgcctcagcagccagctaccccactgtgtgagctggtggacggtgatgaggaaggacttgactggggatggcgcatgcatgggaggaattcatcttcagtctaccagcccccgctgtgtcggatacacactcgaatcattgaagatccgagtgtgatttgaattctgtgatattttcacactggtaaatgttacctctattttaattactgctataaataggtttatattattgattcacttactgactttgcattttcgtttttaaaaggatgtataaatttttacctgtttaaataaaatttaatttcaaatgtagtggtggggcttctttctatttttgatgcactgaatttttgtgtaataaagaacataattgggctctaagccataaaaaaaaaaaaaaaaaaaa

SEQ ID NO: 30 - protein, 333 aa, Homo sapiens [sequence omitted]

SEQ ID NO: 31 - DNA, 1587 bp, Homo sapiens
  CDS (206)..(1207)
ggcggtgccggccgaacccagacccgaggttttagaagcagagtcaggcgaagctgggccagaaccgcgacctccgcaaccttgagcggcatccgtggagtgcgcctgcgcagctacgaccgcagcaggaaagcgccgccggccaggcccagctgtggccggacagggactggaagagaggacgcggtcgagtaggttttaaaacatgaatcctacactcatccttgctgccttttgcctgggaattgcctcagctactctaacatttgatcacagtttagaggcacagtggaccaagtggaaggcgatgcacaacagattatacggcatgaatgaagaaggatggaggagagcagtgtgggagaagaacatgaagatgattgaactgcacaatcaggaatacagggaagggaaacacagcttcacaatggccatgaacgcctttggagacatgaccagtgaagaattcaggcaggtgatgaatggctttcaaaaccgtaagcccaggaaggggaaagtgttccaggaacctctgttttatgaggcccccagatctgtggattggagagagaaaggctacgtgactcctgtgaagaatcagggtcagtgtggttcttgttgggcttttagtgctactggtgctcttgaaggacagatgttccggaaaactgggaggcttatctcactgagtgagcagaatctggtagactgctctgggcctcaaggcaatgaaggctgcaatggtggcctaatggattatgctttccagtatgttcaggataatggaggcctggactctgaggaatcctatccatatgaggcaacagaagaatcctgtaagtacaatcccaagtattctgttgctaatgacaccggctttgtggacatccctaagcaggagaaggccctgatgaaggcagttgcaactgtggggcccatttctgttgctattgatgcaggtcatgagtccttcctgttctataaagaaggcatttattttgagccagactgtagcagtgaagacatggatcatggtgtgctggtggttggctacggatttgaaagcacagaatcagataacaataaatattggctggtgaagaacagctggggtgaagaatggggcatgggtggctacgtaaagatggccaaagaccggagaaaccattgtggaattgcctcagcagccagctaccccactgtgtgagctggtggacggtgatgaggaaggacttgactggggatggcgcatgcatgggaggaattcatcttcagtctaccagcccccgctgtgtcggatacacactcgaatcattgaagatccgagtgtgatttgaattctgtgatattttcacactggtaaatgttacctctattttaattactgctataaataggtttatattattgattcacttactgactttgcattttcgtttttaaaaggatgtataaatttttacctgtttaaataaaatttaatttcaaatgtagtggtggggcttctttctatttttgatgcactgaatttttgtgtaataaagaacataattgggctctaagccataaaaaaaaaaaaaaaaaaaa

SEQ ID NO: 32 - protein, 333 aa, Homo sapiens [sequence omitted]

SEQ ID NO: 33 - DNA, 2756 bp, Homo sapiens
  CDS (1)..(2061)
atgcagttaggggagcagctcttggtgagctcagtgaacctgcctggcgcgcacttctacccgctggagagtgcgcgaggcggcagcggcgggagcgctggccacctccccagcgcggccccctctcctcagaagttggacttagacaaagcgtccaagaagttttccggcagtctctcctgcgaggcggtgagcggggagcccgcagccgccagcgcaggggcccccgcggccatgcttagtgacaccgacgccggggacgcatttgccagcgctgcggcagtggccaagccggggcccccggacggccgcaagggctccccctgcggggaggaggagctgccctccgccgctgcagccgccgccgccgccgccgccgcggctgcggccactgcgcgctactccatggacagcctgagctccgagcggtactacctccagtcccccggtcctcaggggtcggagctggctgcgccctgctcactcttcccgtaccaggcggcggctggggcgccccacggacctgtgtacccggctcctaacggggcgcgctacccctacggctccatgctgccccccggcggcttccccgcggctgtgtgcccacccgggagggcgcagttcggcccaggagccggtgcgggcagtggcgcgggcggtagcagcggcgggggcggcggcccgggcacctatcagtacagccagggggctccgctctacgggccgtaccctggagccgcagcggcgggatcttgcggaggactggggggcctgggggttccaggttctggcttccgtgcccacgtctacctgtgcaaccggcctctgtggctcaaattccaccgccaccaaactgagatgatcattacgaaacagggcaggcgcatgtttcctttcttgagcttcaacataaacggactcaatcccactgcccactacaatgtgttcgtagaggtggtgctggcggaccccaaccactggcgcttccaggggggcaaatgggtgacctgtggcaaagccgacaataacatgcagggcaacaaaatgtatgttcacccagagtctcctaatactggttcccactggatgagacaggagatttcattcgggaaattaaaactcaccaataacaaaggcgcaaataacaacaacacccagatgatagtcttacaatccttacacaaataccaaccccgactgcatattgttgaagttacagaggatggcgtggaggacttgaatgagccctcaaagacccagacttttaccttctcagaaacgcaattcattgcagtgactgcctaccaaaacaccgatattactcaactaaagattgatcataacccctttgcaaaaggcttcagagacaactatgattcatcccatcagattgtccctggaggtcggtacggcgttcaatccttcttcccggagccctttgtcaacactttacctcaagcccgctattataatggcgagagaaccgtgccacagaccaacggcctcctttcaccccaacagagcgaagaggtggccaaccctccccagcggtggcttgtcacgcctgtccagcaacctgggaccaacaaactagacatcagttcctatgaatctgaatatacttctagcacattgctcccatatggcattaaatccttgccccttcagacatcccatgccctggggtattacccagacccaacctttcctgcaatggcagggtggggaggtcgaggttcttaccagaggaagatggcagctggactaccatggacctccagaacaagccccactgtgttctctgaagatcagctctccaaggagaaagtgaaagaggaaattggctcttcttggatagagacacccccttccatcaaatctctagattccaatgattcaggagtatacaccagtgcttgtaagcgaaggcggctgtctcctagcaactccagtaatgaaaattcaccctccataaagtgtgaggacattaatgctgaagagtatagtaaagacacctcaaaaggcatgggagggtattatgctttttacacaactccctaaagagttattttaacctcaaaaattagctaactttttgcagatggacttggtggtgttttttgttgtcttctttgcctaggttgccaaaaagatgtttgccttccaccttgatgcatcctgttttgtgcaattctctaaaagaaggtgccaaagctttttgattgctgcaggtaactgaaacaaacctagcatttttaaaaaataagattaatggaagactttaaggtattttaaaattcgaagggtatccaaggttctgtatttatttattggggagacactaacccttcaaagaagcaggctgtgaacattgggtgcccagtgctatcagatgagttaaaacctttgattctcatttctatttgtaaattcttaagcaaatagaagccgagtgttaaggtgttttgcttctgaaagagggctgtgccttccgtttcagaaggagacattttgctgttacattctgccaggggcaaaagatactaggcccaggagtcaagaaaagcttttgtgaaagtgatagtttcacctgactttgattccttaacccccggcttttggaacaagccatgtttgccctagtccaggattgcctcacttgagacttgctaggcctctgctgtgtgctggggtggccagtgggactcaggagagagcaagctaaggagtcaccaaaaaaaaaaaaaaaaaaaaaa

SEQ ID NO: 34 - protein, 686 aa, Homo sapiens
MQLGEQLLVSSVNLPGAHFYPLESARGGSGGSAGHLPSAAPSPQKLDLDKASKKFSGSLSCEAVSGEPAAASAGAPAAMLSDTDAGDAFASAAAVAKPGPPDGRKGSPCGEEELPSAAAAAAAAAAAAAATARYSMDSLSSERYYLQSPGPQGSELAAPCSLFPYQAAAGAPHGPVYPAPNGARYPYGSMLPPGGFPAAVCPPGRAQFGPGAGAGSGAGGSSGGGGGPGTYQYSQGAPLYGPYPGAAAAGSCGGLGGLGVPGSGFRAHVYLCNRPLWLKFHRHQTEMIITKQGRRMFPFLSFNINGLNPTAHYNVFVEVVLADPNHWRFQGGKWVTCGKADNNMQGNKMYVHPESPNTGSHWMRQEISFGKLKLTNNKGANNNNTQMIVLQSLHKYQPRLHIVEVTEDGVEDLNEPSKTQTFTFSETQFIAVTAYQNTDITQLKIDHNPFAKGFRDNYDSSHQIVPGGRYGVQSFFPEPFVNTLPQARYYNGERTVPQTNGLLSPQQSEEVANPPQRWLVTPVQQPGTNKLDISSYESEYTSSTLLPYGIKSLPLQTSHALGYYPDPTFPAMAGWGGRGSYQRKMAAGLPWTSRTSPTVFSEDQLSKEKVKEEIGSSWIETPPSIKSLDSNDSGVYTSACKRRRLSPSNSSNENSPSIKCEDINAEEYSKDTSKGMGGYYAFYTTP

SEQ ID NO: 35 - DNA, 4446 bp, Homo sapiens
  CDS (87)..(3350)
cgcaccgccgccgaggacgcgcgcccgagcctagtccccacgccgcggcgcgcccgggctccctgctgatcccagaacaatcaaccatgacgaccgaatctggatcagactcggaatccaagccggaccaggaggccgagccccaggaggcggcgggggcgcaggggcgcgcgggggcgcccgtgccggagccgcccaaggaggagcagcagcaggccctggagcagttcgccgccgctgcagcgcacagcaccccggtgcggagggaggtcactgacaaggaacaggagtttgctgccagggctgcaaaacagctcgaatatcagcaattagaagacgataaactttctcagaaatcatctagcagtaaactctctcggtctccattaaagattgtcaaaaagcctaaaagcatgcagtgcaaagtgatacttctcgatggatcagaatatacctgtgatgtagagaaacgctccagaggacaagtgctgtttgataaagtgtgtgaacacttgaacttgctagagaaagactactttgggcttacgtatcgagatgctgaaaaccagaagaattggttggaccctgctaaggaaataaaaaaacaggttcgaagtggtgcttggcacttttcatttaatgtgaaattttatccaccagaccctgcccaactatctgaagatatcaccaggtactacctctgcttgcagttgcgagatgacatcgtgtccggaaggctgccctgctcctttgttaccctggccttgctgggctcctacactgtccagtcagagctcggagactatgacccagatgaatgtgggagcgattacattagtgagttccgctttgcaccaaaccacactaaagaactggaagacaaagtgatcgagctgcacaagagccacagaggaatgacgccagcagaagcagagatgcatttcttggaaaatgccaaaaaattatcaatgtatggggtagatttacatcatgctaaggactcagaaggggtagaaattatgttaggagtttgtgcaagtggtctgttgatatatcgcgaccggctgcgaataaacagatttgcctggcccaaggttctaaagatttcatacaaacggaacaacttttacattaagatccggccgggagagtttgaacaatttgaaagcaccattgggtttaagctgccaaaccatcgagctgccaagcgtttatggaaagtatgtgttgagcatcatacatttttcagactactgttaccagaagcacctcccaagaaattcctaaccttgggttccaagtttcgttatagtggcaggacacaagcgcaaacgagaagagccagtgcgttgatagatcgcccagcaccttactttgaacgctcatccagcaaacgttataccatgtctcgcagcttggatggagaggttggtactggccagtacgccacaacaaaaggcatctctcagaccaacttgatcaccactgtgactccggagaagaaggctgaggaggagcgggacgaggaagaggacaaacggaggaagggggaagaagtcacgcccatctcggccatccggcacgagggaaagtcacctgggcttggcactgactcatgtcccttgtcacccccatccacccattgtgcccccacatctcccacagagctccgtaggaggtgtaaggagaatgactgcaaactgccaggttatgagccgtccagagctgagcacctgcctggagagcccgccttggactctgatggcccagggaggccttacctaggggatcaagatgtggcttttagctacagacagcaaactggcaaggggaccaccctgttctccttctccttgcagctccctgagtcattcccctccctcctagatgatgatggatacctctctttccccaacctttctgaaaccaacctcctgccccagagcttgcagcattacctcccgatccgctcaccgtcccttgtgccctgtttcctcttcatctttttctttctgctgtctgcctccttctcagtgccatacgctctcactctctccttccctctggctctgtgcctctgctacctggagcccaaggcggcctccttgagcgcctccctagacaatgacccgagtgacagttcagaggaagagactgacagtgagcgcacggacaccgcagccgacggggagaccaccgccactgagtcggaccaggaggaagatgcagagctcaaggcacaggagctagaaaaaactcaagatgacctgatgaaacatcaaaccaacattagcgagctgaaaagaaccttcttagaaacctcaacagacactgccgtaacgaatgaatgggagaagaggctttccacctcccccgtgcgactggccgccaggcaggaggatgcccccatgatcgaaccacttgtccctgaagagactaagcagtcttctggggaaaagctcatggatggctctgaaatcttcagtttattagagtctgcgcgaaaaccaacagaattcataggaggggttacttctacttctcaaagctgggttcagaaaatggaaaccaagacggagtccagtggaatagagacggaacccaccgtgcaccacctgccgcttagcactgagaaggtggtgcaggagaccgtgttggtggaggagcggcgtgtggtgcacgcgagtggggatgcttcttactcggcgggagacagcggggatgctgcagcacagcccgcattcacaggcattaaagggaaagagggctctgccttgacggagggggctaaagaggaaggaggggaggaggtcgctaaagctgtcctggaacaggaagagacagccgctgcttcccgtgagcgacaagaggagcagagtgcagccatccacatttcagaaactttggaacaaaaacctcattttgagtcctcaacggtgaagacggaaaccatcagttttggcagtgtttcaccgggaggagtaaagctagaaatttccacgaaggaagtgccagtagttcacaccgaaaccaaaaccatcacatatgaatcatcacaggtcgatccaggcacagatctggagccaggcgtgctgatgagtgcacagacgatcacatctgaaaccaccagtaccaccaccactacgcacatcaccaaaactgtgaaagggggcatttcagagacaagaattgagaagcgaatagtcatcacgggggatgcagacattgaccatgaccaggcgctggctcaggcaattaaagaggccaaagagcagcaccctgacatgtcagtgaccaaagtagtggtccataaagagacagagatcacaccagaagatggagaggattgaccagaggaataacttagcttgcacatgaatgcagtcatgcaaaccgttaggaaaaccagagcctatatggagttccctcttctaacccaactgacttgtatctgtccgtggaaaatttcagtccagaagaattgaccttgaccattaataaagacactggcagagagatcttcccataataaagcaatctgattcagcatcactaaaccgataatgcatgaagcaacgataaaattacaaaagagcagcatttttaattttcacaaaatgtctcagttttcagctatacctgcacgttcataaccaacaatataaaccgtggtctcatgtaacacataaacaattcatgcctttcatagtttattattattaaagtctaaacaaaattgcaatttcttaggtaaccttatatttacaataaatgaagattaccctcaaatgctagaagctgtctaggtccgtccggtgtgtcagattttcctcagattagatgtgccaataaccaagtttattcagtaaacaacttgtacttgtttcatctggttttattactctcacccataaacagtaatgactctctgaccctctggaaatatgtaatgcttccaatcttgctttgtgtatctcatttaatttgttataaggtagtactgattttagcatattaatgcgatttcttccttgttgtttgctttggtctgtgttcaatccagagagcttaaattgtcattattttgggaagaaaacctgtatttttgttagtttacaatattatgaaatttcacttcaggagaaactgctgggcttcctgtggctttgttttcttagttactttttccgtgccgtgtattttttaattgatttttcttcttttacttgaaaagaaagtgttttattttcaaatctggtccatatttacattctagttcagagccaagccttaaactgtacagaatttccactgtaattaaaactatttagtgttagttataaatagccttcaaaaagagagattctccattacacgatcacctgcatcacagcccatggtgaatgtatgtttctgcatagcgaaataaaaatggcaaatgcactg

SEQ ID NO: 36 - protein, 1087 aa, Homo sapiens
MTTESGSDSESKPDQEAEPQEAAGAQGRAGAPVPEPPKEEQQQALEQFAAAAAHSTPVRREVTDKEQEFAARAAKQLEYQQLEDDKLSQKSSSSKLSRSPLKIVKKPKSMQCKVILLDGSEYTCDVEKRSRGQVLFDKVCEHLNLLEKDYFGLTYRDAENQKNWLDPAKEIKKQVRSGAWHFSFNVKFYPPDPAQLSEDITRYYLCLQLRDDIVSGRLPCSFVTLALLGSYTVQSELGDYDPDECGSDYISEFRFAPNHTKELEDKVIELHKSHRGMTPAEAEMHFLENAKKLSMYGVDLHHAKDSEGVEIMLGVCASGLLIYRDRLRINRFAWPKVLKISYKRNNFYIKIRPGEFEQFESTIGFKLPNHRAAKRLWKVCVEHHTFFRLLLPEAPPKKFLTLGSKFRYSGRTQAQTRRASALIDRPAPYFERSSSKRYTMSRSLDGEVGTGQYATTKGISQTNLITTVTPEKKAEEERDEEEDKRRKGEEVTPISAIRHEGKSPGLGTDSCPLSPPSTHCAPTSPTELRRRCKENDCKLPGYEPSRAEHLPGEPALDSDGPGRPYLGDQDVAFSYRQQTGKGTTLFSFSLQLPESFPSLLDDDGYLSFPNLSETNLLPQSLQHYLPIRSPSLVPCFLFIFFFLLSASFSVPYALTLSFPLALCLCYLEPKAASLSASLDNDPSDSSEEETDSERTDTAADGETTATESDQEEDAELKAQELEKTQDDLMKHQTNISELKRTFLETSTDTAVTNEWEKRLSTSPVRLAARQEDAPMIEPLVPEETKQSSGEKLMDGSEIFSLLESARKPTEFIGGVTSTSQSWVQKMETKTESSGIETEPTVHHLPLSTEKVVQETVLVEERRVVHASGDASYSAGDSGDAAAQPAFTGIKGKEGSALTEGAKEEGGEEVAKAVLEQEETAAASRERQEEQSAAIHISETLEQKPHFESSTVKTETISFGSVSPGGVKLEISTKEVPVVHTETKTITYESSQVDPGTDLEPGVLMSAQTITSETTSTTTTTHITKTVKGGISETRIEKRIVITGDADIDHDQALAQAIKEAKEQHPDMSVTKVVVHKETEITPEDGED

SEQ ID NO: 37 - DNA, 6926 bp, Homo sapiens
  CDS (195)..(2981)
cccacggatcatcagaaggcgcggacctggaggaggcgccccagaaggcgacgcctcttgcctcctgtctctcgcctctcgaaggaagtttgctcttaatttcagagccgggttcgccgtcggatcaacctccaggagctagcagcgggcgcggaccgggcagtttccgcgctcagcacaggcagctcgcggtcatgggcggctcagcctccagccagctggacgagggcaagtgcgcttacatccgagggaaaactgaggctgccatcaaaaacttcagtccctactacagtcgtcagtactctgtggctttctgcaatcacgtgcgcactgaagtagaacagcaaagagatttaacgtcacagtttttgaagaccaagccaccattggcgcctggaactattttgtatgaagcagagctatcacaattttctgaagacataaagaagtggaaggagagatacgttgtagttaaaaatgattatgctgtggagagctatgagaataaagaggcctatcagagaggagctgctcctaaatgtcgaattcttccagccggtggcaaggtgttaacctcagaagatgaatataatctgttgtctgacaggcatttcccagaccctcttgcctccagtgagaaggagaacactcagccctttgtggtcctgcccaaggaattcccagtgtacctgtggcagcccttcttcagacacggctacttctgcttccacgaggctgctgaccagaagaggtttagtgccctcctgagtgactgcgtcaggcatctcaatcatgattacatgaagcagatgacatttgaagcccaagcctttttagaagctgtgcaattcttccgacaggagaagggtcactatggttcctgggaaatgatcactggggatgaaatccagatcctgagtaacctggtgatggaggagctcctgcccactcttcagacagacctgctgcctaagatgaaggggaagaagaatgacagaaagaggacgtggcttggtctcctcgaggaggcctacaccctggttcagcatcaagtttcagaaggattaagtgccttgaaggaggaatgcagagctctgacaaagggcctggaaggaacgatccgttctgacatggatcagattgtgaactcaaagaactatttaattggaaagatcaaagcgatggtggcccagccggcggagaaaagctgcttggagagtgtgcagccattcctggcatccatcctggaggagctcatgggaccagtgagctcgggattcagtgaagtacgtgtactctttgagaaagaggtgaatgaagtcagccagaacttccagaccaccaaagacagtgtccagctaaaggagcatctagaccggcttatgaatcttccgctgcattccgtgaagatggaaccttgttatactaaagtcaacctgcttcacgagcgcctgcaggatctcaagagccgcttcagattcccccacattgatctggtggttcagaggacacagaactacatgcaggagctaatggagaatgcagtgttcacttttgagcagttgctttccccacatctccaaggagaggcctccaaaactgcagttgccattgagaaggttaaactccgagtcttaaagcaatatgattatgacagcagcaccatccgaaagaagatatttcaagaggcactagttcaaatcacacttcccactgtgcagaaggcactggcgtccacatgcaaaccagagcttcagaaatacgagcagttcatctttgcagatcataccaatatgattcacgttgaaaatgtctatgaggagattttacatcagatcctgcttgatgaaactctgaaagtgataaaggaagctgctatcttgaagaaacacaacttatttgaagataacatggccttgcccagtgaaagtgtgtccagcttaacagatctaaagccccccacagggtcaaaccaggccagccctgccaggagagcttctgccattctgccaggagttctgggtagtgagaccctcagtaacgaagtattccaggagtcagaggaagagaagcagcctgaggtccctagctcgttggccaaaggagaaagcctttctctccctgggccaagcccacccccagatgggactgagcaggtgattatttcaagagtggatgaccccgtggtgaatcctgtggcaacagaggacacagcaggactcccgggcacatgctcatcagagctggagtttggagggacccttgaggatgaagaacccgcccaggaagagccagaacccatcactgcctcgggttctttgaaggcgctcagaaagttgctgacagcgtccgtggaagtaccagtggactctgctccagtgatggaagaagatacgaatggggagagccacgttccccaagaaaatgaagaagaagaggaaaaagagcccagtcaggcagctgccatccaccccgacaactgtgaagaaagtgaagtcagcgagagggaggcccaacctccctgtcccgaggcccatggggaggagttggggggatttccagaggtaggcagcccagcctctccgccagccagtggagggctcaccgaggagcccctggggcccatggagggggagctcccaggagaggcctgcacactcactgcccatgaaggaagagggggcaagtgtaccgaggaaggggatgcctcacagcaagagggctgcaccttaggttctgaccccatctgcctcagtgagagccaggtttctgaggaacaagaagagatgggagggcaaagcagcgcggcccaggccacggccagtgtgaatgcagaggagatcaaggtagcccgtattcatgagtgtcagtgggtggtggaggatgctccaaacccggatgtcctgctgtcacacaaagatgacgtgaaggagggagaaggtggtcaggagagtttcccagagctgccctcagaggagtgaaagggacaatttggctgaagtctttctctgaaaaaagccaaagggttataggggtacacttaggggttgcatgcaagctgttaccaaaaaatttttaagtattttcttaatttgaataataaaaccagaggaaatgcatacagggcatgagcaactgaggcaaacctttgtggacatgaattgttctacgatgaatttttgctttagtattttaataagaattacaaagacaatggcatacttggggtgagagggagctgaggatgtctgaggagggaatagtattgcagggaagactgagaaaacagtaggatgacagttttgagtatactctgcacttttcaattgtgcaatcttcttgtgcactttaaggctttttaattttgtttgagaatgcaaatgtatactgtaagtctacctttactatctactatgcctacttcaccatctcttaaggactcggcatttgtccacagtcagactgcaagagagggtaggtcatgaacagtcacccgtgctggctgtagcccccacagaggcaatcatgcccaatagattcaagagaagctaagcggaaatggagggtggaaggtgtgatctgtgggactgtctgggcctgttactcatcctgctatcaatttcttattaattaatcttgatgattcttattaattaatcacatttgcaggaaattcagatgaggcaagaaaattttattggcctgggtaagactgaaagcattccaaattaggcttagactgtgcaaagggcttagctaagttatcgagcttaaaacccgtcaattaaacaaacattatttgaacagttactgcatgccacgcactgtgttgggcttagtaataaaaaaaagaaaagataagtgcttgttctagcataaattaaaaggtccaagggaatttaatctggaagagaacatatgccaatttttaaactatgacagcttttttttttctctttccattcaaatagtcctggttcattcccagaagggcacaaaatgaatgaataaataaataaatgaataaagacaaaagccaaggtgtatgctctcaagttccaaagatgttatcaaaagctgaaatcatttgtttggtcattcagcaagctaattgagtctctgttatataccaagcactggggataccatggcgaaaaacaactttgttccttcctcctagaacttacattttaatggaaatagacaaaacacatcttcttaacggatggtgacctataaccattaatgttgaaaatggaagagacttgcttccaaaagattaaaaggagttgttcttttctccttcagaaaaataccagatcatttcctaaaatctccagtcccaagtattacatcgtggtttccctccccgactttttattttattttattctatttttttgagatggagtctcactctgtcgccaaggctggagtgcagtggtgtgatctcggctcactgcaacctccgcctcctgggttcaggagattctcctctgtcagcgtcccaagtagctggaattacagccatgcggcaccattcccggctaatttttgtatttttggtagagatgggttttcaccatgttggccaggctggtctcaaactcctgatttcaagcgatccacccacctcgacttcccaaagtgctgggattacagcgtgagctacctggcccctccccaaattttaacatcagatctcaacatatttgttgagaacttgtttagatcatcactatcgagtaaatttatgtcagttctttagagcatttgcttcacacacagttcaaccatttaaccagaaattaaaatatcacccttttcagccctcccatgaagaatttctaggtcataaacatgaataatactcagtatatgtataatatcatatttaattgttgcaacttttcttggcgtgtttaaatcctcatgtctttgagggatcccaccacaggtgaaggaagtaaagaccacttctcccccagtctctgctttctgcagtgctcactcatatcctggcatttagcatggtgtgttgaaattaggtttacttcttgtctctccaagtggctcctctcttaaaagacagaaactagggtttagtcatcatttgtgcttcctgctagaaacccacagccttgaataatggcttcctgcctccttgagtcactttaatatccctggtgcataggacctggcatgcgtcaggctgctcgggaaatgtgggaactggacacccagaacactgctgtgctggggctatttggggcctgctgtcaggcagaaagacgttttgaattgggctttctgcccttgttgagttttctcttaagtaaagtccaaagtccaaggggcagatggccagatgcactgcccagtaaggcaggaagccaaagaggcagtgcccagccccacaaaggctgcccgactccctgggacagtagtgtggagtcccagcccaggctgacctcacaccggagcttcctagcttcctttctttgctcaatgcagggcttcttgcaccccctggaaagctaagagatttttttcaaccctaaaagagagtacctttcactgcattggatggatgaacatcagtgccctaactttatccatcatgtaggtcagggaggactgggcactatttggcaggatgtactccagaatataatcaaagaattttctgtacatatttcactaaagacaagtttttgggctggatgtggtagcttacacctataatcccagcactttgggaggctgaggtgagagggtcacttgagcccaggagttctagacaagcctgggaaacatagcaagatctcatccttacaaaaaataataatggtgtgtgcctgcagtcctagctacttgggtggttgaggcaggaggattgtttgagcgagggaagttgaggctgcagtgaactatgattttaccactgcactccagcttgggcaacaaaatgagaccctgtctcaaaaaaaaaaaaaaagttttctagaataagcaggatgattgtttaatttgaagatggaacaggaaactagagtgcatttaaaatactctgtcttcattttaacatgttgaatggaataactgcatatcaccatgagtttgttttgcttttcatacagacttgtatgtgtcatttgagtggtttccagattggagcgaggttattctgatctaaatgaacagcatttttttccttagcctctgtttgccactctgggtatctctcctatgggcaaagccattagaaatgcataaaacctcgagacatggtttttggcaaaaactccatgactttaaactagctcttttactactgacctttcacagagaaaaaatatttcccttgaaaaaaactgggcttgtcattttttcccttgtagctttaagcagagacataagtgccttgcattacacatagtaaactttctttaaaaaaaaaaaaaaaagattttggagactaccagggtaagattccaacttgtccaaaagctttctggccttacatattttattataaaaattctcaagtctggtaatcttctatgtcagagctagtgatttcaaaaggtttcacaattccccaagacaaaagtgattttcgttcattataataaggttaagtgatatgtgattcatagcaattttgatgtgaagaagggaaggacatcattgacttaataatagtatcagtcggtgcaacagttggcaacatgtgccttcacactttaccataaagagacgggtttgagggtttgccttctaaagtctgcaacttcaagaaaaaaaatcgacactgtggattgactttcccggtcactatataaagcaaataaacttaaaacactttgtaaccatgtatttactctgccaggtgcctatattccaataaaatgttcatccttgaa

SEQ ID NO: 38 - protein, 928 aa, Homo sapiens
MGGSASSQLDEGKCAYIRGKTEAAIKNFSPYYSRQYSVAFCNHVRTEVEQQRDLTSQFLKTKPPLAPGTILYEAELSQFSEDIKKWKERYVVVKNDYAVESYENKEAYQRGAAPKCRILPAGGKVLTSEDEYNLLSDRHFPDPLASSEKENTQPFVVLPKEFPVYLWQPFFRHGYFCFHEAADQKRFSALLSDCVRHLNHDYMKQMTFEAQAFLEAVQFFRQEKGHYGSWEMITGDEIQILSNLVMEELLPTLQTDLLPKMKGKKNDRKRTWLGLLEEAYTLVQHQVSEGLSALKEECRALTKGLEGTIRSDMDQIVNSKNYLIGKIKAMVAQPAEKSCLESVQPFLASILEELMGPVSSGFSEVRVLFEKEVNEVSQNFQTTKDSVQLKEHLDRLMNLPLHSVKMEPCYTKVNLLHERLQDLKSRFRFPHIDLVVQRTQNYMQELMENAVFTFEQLLSPHLQGEASKTAVAIEKVKLRVLKQYDYDSSTIRKKIFQEALVQITLPTVQKALASTCKPELQKYEQFIFADHTNMIHVENVYEEILHQILLDETLKVIKEAAILKKHNLFEDNMALPSESVSSLTDLKPPTGSNQASPARRASAILPGVLGSETLSNEVFQESEEEKQPEVPSSLAKGESLSLPGPSPPPDGTEQVIISRVDDPVVNPVATEDTAGLPGTCSSELEFGGTLEDEEPAQEEPEPITASGSLKALRKLLTASVEVPVDSAPVMEEDTNGESHVPQENEEEEEKEPSQAAAIHPDNCEESEVSEREAQPPCPEAHGEELGGFPEVGSPASPPASGGLTEEPLGPMEGELPGEACTLTAHEGRGGKCTEEGDASQQEGCTLGSDPICLSESQVSEEQEEMGGQSSAAQATASVNAEEIKVARIHECQWVVEDAPNPDVLLSHKDDVKEGEGGQESFPELPSEE

SEQ ID NO: 39 - DNA, 9378 bp, Homo sapiens
  CDS (1)..(9213)
atgggtgccctatggagctggtggatactctgggctggagcaaccctcctgtggggattgacccaggaggcttcagtggacctcaagaacactggcagagaggaattcctcacagccttcctgcagaactatcagctggcctacagcaaggcctacccccgcctccttatctccagtctgtcagagagccccgcttcagtctccatcctcagccaggcagacaacacctcaaagaaggtcacagtgaggcccggggagtcggtcatggtcaacatcagtgccaaggctgagatgataggcagcaagatcttccagcatgcggtggtgatccattctgactatgccatctctgtgcaggcactaaatgccaagcctgacacagcggagctgacactgctgcggcccatccaggccctaggcaccgagtattttgtgctcacaccccccggcacctcagccaggaatgtcaaggagtttgccgtggtggccggtgccgcaggtgcctcggtcagtgtcacgctgaaggggtcagtgacattcaatggcaagttctatccagcaggcgatgtcctaagagtgactctacagccctacaatgtggcccagctacagagctcagtggatctctcggggtcaaaggtcacagctagtagccccgtggctgtcctctctggccacagctgtgcgcagaaacatacgacctgcaaccatgtggttgagcagctgctacccacgtctgcctggggcacccactatgtagtacccacgctggcctcccaatctcgctatgatttggccttcgttgtggccagccaggccacaaagctgacctacaaccatgggggtatcactggctcccgtgggctccaggcaggtgatgtggtagagtttgaggtccggccatcctggccactctacctgtctgcaaatgtgggcatccaggtcctgttgtttggcacaggtgccataaggaatgaagtgacttatgacccctacctggtcctgatcccagatgtggcggcctactgcccagcctatgtggtcaagagtgtaccaggctgtgagggcgtggccctggtagtggcacagacgaaggctatcagcgggctgaccatagatgggcatgcagtgggggccaagctcacctgggaggctgtgccaggcagtgagttctcgtatgctgaagtggagctcggcacagctgacatgatccacacggccgaggccaccaccaacttgggactgctcaccttcgggctggccaaggctataggctacgcaacagctgctgattgcggccggactgtactgtccccagtggagccctcctgcgaaggcatgcagtgcgcagccgggcagcgctgccaggtggtaggcgggaaggccgggtgtgtggcggagtccaccgctgtctgccgcgcccagggcgacccccattacaccaccttcgacggccgtcgctacgacatgatgggcacctgttcgtacacgatggtggagctgtgcagcgaggacgacaccctgcccgccttcagcgtggaggccaagaacgagcaccggggcagccgccgcgtctcctacgtgggcctcgtcactgtgcgcgcctacagccactctgtgtcgctgacccgcggtgaagttggcttcgtcctggttgacaaccagcgctcgcgcctgccagtctccctgagtgagggtcgcctgcgtgtgtaccagagcggaccacgggccgtggtggagctggtctttgggctggtggtcacttatgactgggactgccagctggcactcagcctgcctgcacgcttccaagaccaggtgtgcgggctgtgtggcaactataatggtgacccagcagacgacttcctcacgcctgacggggctctggctcctgacgctgtggagttcgcaagtagctggaagctggatgatggggactacctgtgtgaggatggctgccagaacaactgtcccgcctgcaccccaggccaggcccaacactatgagggcgaccgactctgtggcatgctgaccaagctcgatggccccttcgctgtctgccatgacaccctggaccccaggcccttcctggagcagtgtgtatatgacctgtgtgtggtcggtggggagcggctcagcctgtgccgtggcctcagcgcctatgcccaggcctgtctggagcttggcatctcggttggggactggagatcaccagccaactgccccctgtcctgccctgccaacagccgctatgagctctgcggccctgcttgcccgacctcctgcaacggggctgcggcgccgtccaactgctccgggcgcccctgcgtggagggctgcgtgtgcctcccaggcttcgtggccagcggcggcgcctgcgtgccggcctcgtcgtgtggctgcaccttccagggtctccagctcgctccgggccaggaagtgtgggcggacgagttgtgccaaaggcgctgcacctgcaacggcgccacccatcaggtcacctgccgcgacaagcagagctgcccggcgggtgagcgctgcagcgtccagaacggcctcctgggctgctaccccgatcgcttcgggacctgccaggggtccggggacccacactatgtgagcttcgacggccggcgcttcgacttcatgggcacctgcacgtacctgctggtcggctcatgcggccagaacgcagcgctgcctgccttccgggtgctggtggaaaacgagcatcggggcagccagactgtgagctacacgcgcgccgtgcgggtggaggcccgcggggtgaaggtggccgtgcgccgggagtaccccgggcaagtgctggtggatgacgtccttcagtatctgcccttccaagcagcagatgggcaggtgcaggtgttccgacagggcagggatgccgtcgtgcgcacggactttggcctgactgtcacttatgactggaatgcacgagtgactgccaaggtgcccagcagctatgctgaggccctgtgtggactctgtgggaacttcaacggggacccagctgatgacctggctctgcggggtgggggtcaagctgccaatgcactggcctttgggaacagctggcaagaagagacgaggcccggctgtggagcaactgaaccgggtgactgtcccaagctggactccctggtggcccagcagctgcagagcaagaatgagtgtggaatccttgccgaccccaaggggcccttccgggagtgccatagcaagctggacccccagggtgccgtgcgcgactgtgtctatgaccgctgcctgctgccaggccagtctgggccactgtgtgacgcactggccacctatgctgctgcatgccaggctgctggagccacagtgcacccctggaggagtgaagaactttgcccactgagctgcccaccccacagccactatgaggcgtgttcctacggctgcccgctgtcctgtggagacctcccagtgcccgggggctgtggctcagaatgccatgagggctgcgtgtgcgatgagggctttgcgctcagtggtgagtcctgcctgcccctggcctcctgtggctgcgtacaccagggcacctaccacccaccaggccagaccttctaccctggccccggatgtgattccctttgccactgccaggagggcggcctggtgtcctgtgagtcctccagctgcggaccgcacgaggcctgccagccatccggtggcagcttgggctgtgtggccgtgggctctagcacctgccaggcgtcaggagacccccactacaccaccttcgatggccgccgcttcgacttcatgggcacctgcgtgtatgtgctggctcagacctgcggcacccggcctggcctgcatcggtttgccgtcctgcaggagaacgtggcctggggtaatgggcgagtcagtgtgaccagggtgatcacggtccaggtggcaaacttcaccctgcggctggagcagagacagtggaaggtcacggtgaacggtgtggacatgaagctgcccgtggtgctggccaacggccagatccgtgcctcccagcatggttcagatgttgtgattgagaccgacttcggcctgcgtgtggcctacgaccttgtgtactatgtgcgggtcaccgtccccggaaactactaccagcagatgtgtggcctgtgtgggaactacaacggcgaccccaaggatgacttccagaagcccaatggctcacaggcaggcaacgccaatgagttcggcaactcctgggaggaggtggtgcccgactctccctgcctgccgcccaccccttgcccgccggggagcgaggactgtatccccagccacaagtgtcctcccgagctggagaagaagtatcagaaggaggagttctgtgggctcctctccagccccacagggccactgtcctcctgccacaagctggtggatccccagggtcccttgaaagattgcatctttgatctctgcctgggtggtgggaacctgagcattctctgcagcaacatccatgcctacgtgagtgcttgccaggcggctggaggccacgtggagccctggaggactgaaactttctgtcccatggagtgccctccgaacagtcactacgagctctgtgcggacacctgctccctgggctgctcagctctcagtgcccctccacagtgccaggatgggtgtgctgagggctgccagtgtgactccggcttcctctacaatggccaagcctgcgtgcccatccagcaatgcggctgctaccacaatggtgtctactatgagccggagcagacagtcctcattgacaactgtcggcagcagtgtacgtgccatgcgggtaaaggcatggtgtgccaggaacacagctgcaagccggggcaggtgtgccagccctccggaggcatcctgagctgcgtcaccaaaggtgctgagctggggttgggcctggggctgatgcgactagggatggaggacaaggactctggggctgagggtggtgtaactggggtgtccatggcgggagtaaccctcagatccctggcacagactggggtagatgtggagggagcggccatcctttacaatgggcagcccctcaaggtcctcctccctcttctgtccccagacccgtgccacggcgtgacatgccggccacaggagacatgcaaggagcagggtggccagggcgtgtgcctgcccaactatgaggccacgtgctggctgtggggcgacccacactaccactccttcgatggccggaagtttgacttccagggcacctgtaactatgtgctggcaacaactggctgcccgggggtcagcacccagggcctgacacccttcaccgtcaccaccaagaaccagaaccggggcaaccctgctgtgtcctacgtgagagtcgtcaccgtggctgccctcggcaccaacatctccatccacaaggacgagatcggcaaagtccgggtgaacggtgtgctcacagccttgcctgtctccgtggccgacgggcggatttcagtggcccagggtgcatcgaaggcactgctggtggctgactttggactgcaagtcagctatgactggaactggcgggtagacgtgacgctccccagcagctatcatggcgcagtgtgcgggctctgcggtaacatggaccgcaaccccaacaatgaccaggtcttccctaatggcacactggctccctccatacccatctggggcggcagctggcgagccccaggctgggacccactgtgttgggacgaatgtcgggggtcctgcccaacgtgccctgaggaccggttggagcagtacgagggccctggcttctgcggacccctggcatctggcacagggggccccttcaccacctgccatgctcatgtgccacctgagagcttcttcaagggctgtgttctggacgtctgcatgggtggtggggaccgtgacattctttgcaaggctctggcttcctacgtggccgcctgccaggccgctggggttgtcatcgaagactggcgggcacaggttggctgtgagatcacctgcccagaaaacagccactatgaggtctgtggcccaccctgcccggccagctgtccgtcccctgcaccccttacgacgccagccgtatgtgagggcccctgtgtggagggctgccagtgcgacgcgggtttcgtgttaagtgctgaccgctgtgttcccctcaacaacggctgcggctgctgggccaatggcacctaccacgaggcgggcagtgagttttgggctgatggcacctgctcccagtggtgtcgctgcgggcctgggggtggctcgctggtctgcacacctgccagctgtgggctgggtgaagtgtgtggcctcctgccatccggccagcacggctgccagcccgtcagcacagctgagtgccaggcgtggggtgacccccattacgtcactctggatgggcaccgattcgatttccaaggcacctgcgagtacctgctgagtgcaccctgccacggaccacccttgggggctgagaacttcactgtcactgtagccaatgagcaccggggcagccaggctgtcagctacacccgcagtgtcaccctgcaaatctacaaccacagcctgacactgagtgcccgctggccccggaagctacaggtcgacggcgtgttcgtggctctgcctttccagctggactcgctcctgcacgcacacctgagcggcgccgacgtggtggtgaccacaacctcagggctctcgctggctttcgatggggacagcttcgtgcgcctgcgcgtgccggcggcgtacgcggcctctctctgtggcttatgcgggaactacaaccaggaccccgcagacgacctgaaggctgtgggcgggaagcccgctggatggcaggtgggcggggcccagggctgcggggaatgtgtgtccaagccatgcccgtcgccgtgcaccccagagcagcaggagtccttcggcggcccggacgcctgcggcgtgatctccgccaccgacggcccgctggcaccctgccacggccttgtgccgcccgcgcagtacttccagggctgcttgctggacgcctgccaagttcagggccatcctggaggcctctgtcctgcagtggctacctacgtggcagcctgtcaggccgctggggcccagctcggcgagtggaggcggccggacttctgtcccttgcagtgccctgcccacagccactatgagctctgcggtgactcctgccctgtgagctgcccgagcctctcagcacccgagggctgtgagtcggcctgccgtgaaggctgtgtctgcgatgctggcttcgtactcagtggtgacacctgcgtacccgtgggccagtgtggctgcctccatgatggccgctactacccactgggcgaggtcttctacccgggccctgagtgtgagcggcgctgtgagtgtgggccaggtggccatgtcacctgccaggagggcgcagcctgtgggccccatgaggagtgccggttagaggatggtgtccaggcctgtcatgccacaggctgtggccgctgcctggccaacgggggcatccactacatcacccttgatggccgtgtctacgacctgcatggctcctgctcctatgtcttggcccaagtctgccacccaaagcctggggacgaggacttttccatcgtgcttgagaagaatgcagctggagatctccaacgcctcctggttactgtggctggccaggttgtgagcctagctcaggggcagcaggtcaccgtggacggcgaggctgtggccctgcctgtggctgtgggccgcgtgcgggtgaccgccgagggccgaaacatggttctgcagacgaccaaggggctgcggcttctctttgatggcgatgcccacctcctcatgtccatccccagccccttccgtggacggctctgtggcctctgtgggaacttcaatggcaactggagtgacgactttgtcctgcccaatggctcagcagcgtccagtgtggagaccttcggggctgcatggcgggcgcccggctcctccaagggctgtggcgagggctgcgggccccaaggctgcccagtgtgcttggcagaggagactgcaccctatgagagcaacgaggcctgcgggcagctccggaacccccagggccccttcgcgacctgccaggcggtgctgagtccctctgagtacttccgccaatgcgtatacgacctgtgcgcgcaaaagggtgacaaagccttcctgtgccgcagcctggcagcctacacggcggcctgtcaggcagctggcgtggccgtgaagccctggaggacagacagcttctgcccgctccattgccccgcccacagccactactccatctgcactcgcacctgccagggatcctgtgcggctctctccggcctcacgggctgcaccacccgctgttttgagggctgtgagtgcgacgaccgcttcctgctttcccagggtgtctgcatccctgtccaagattgtggctgcacccataatggccgatacttgccggtaaactcctccctgctgacctcagactgcagcgagcgctgttcctgttcctcaagctctggcctgacatgccaggccgctggctgcccaccaggccgtgtatgtgaggtcaaggctgaagcccggaactgctgggccacccgtggtctctgtgtcctgtctgtgggtgccaacctcaccacctttgatggggcccgtggtgccaccacctctcctggtgtctatgagctctcttcccgctgcccaggactacagaataccatcccctggtaccgtgtagttgccgaagtccagatctgccatggcaaaacggaggctgtgggccaggtccacatcttcttccaggatgggatggtgacgttgactccaaacaagggtgtgtgggtgaatggtctccgagtggatctcccagctgagaagttagcatctgtgtccgtgagtcgtacacctgatggctccctgctagtccgccagaaggcaggggtccaggtgtggcttggagccaatgggaaggtggctgtgattgtcagcaatgaccatgctgggaaactgtgtggggcctgtggaaactttgacggggaccagaccaatgattggcatgactcccaggagaagccagcgatggagaaatggagagcgcaggacttctccccatgttatggctgatcagtcatccaccaggaacgaagatttcctgaagaagacctggtccctctggaggttgcagtggctgaaggatgcatcatgtgctcctaccctgctctaccgcttttctgggtcacagaggccaaatgtgagagcattgaataaatatcttaagctaagctgcat

SEQ ID NO: 40 - protein, 3070 aa, Homo sapiens
MGALWSWWILWAGATLLWGLTQEASVDLKNTGREEFLTAFLQNYQLAYSKAYPRLLISSLSESPASVSILSQADNTSKKVTVRPGESVMVNISAKAEMIGSKIFQHAVVIHSDYAISVQALNAKPDTAELTLLRPIQALGTEYFVLTPPGTSARNVKEFAVVAGAAGASVSVTLKGSVTFNGKFYPAGDVLRVTLQPYNVAQLQSSVDLSGSKVTASSPVAVLSGHSCAQKHTTCNHVVEQLLPTSAWGTHYVVPTLASQSRYDLAFVVASQATKLTYNHGGITGSRGLQAGDVVEFEVRPSWPLYLSANVGIQVLLFGTGAIRNEVTYDPYLVLIPDVAAYCPAYVVKSVPGCEGVALVVAQTKAISGLTIDGHAVGAKLTWEAVPGSEFSYAEVELGTADMIHTAEATTNLGLLTFGLAKAIGYATAADCGRTVLSPVEPSCEGMQCAAGQRCQVVGGKAGCVAESTAVCRAQGDPHYTTFDGRRYDMMGTCSYTMVELCSEDDTLPAFSVEAKNEHRGSRRVSYVGLVTVRAYSHSVSLTRGEVGFVLVDNQRSRLPVSLSEGRLRVYQSGPRAVVELVFGLVVTYDWDCQLALSLPARFQDQVCGLCGNYNGDPADDFLTPDGALAPDAVEFASSWKLDDGDYLCEDGCQNNCPACTPGQAQHYEGDRLCGMLTKLDGPFAVCHDTLDPRPFLEQCVYDLCVVGGERLSLCRGLSAYAQACLELGISVGDWRSPANCPLSCPANSRYELCGPACPTSCNGAAAPSNCSGRPCVEGCVCLPGFVASGGACVPASSCGCTFQGLQLAPGQEVWADELCQRRCTCNGATHQVTCRDKQSCPAGERCSVQNGLLGCYPDRFGTCQGSGDPHYVSFDGRRFDFMGTCTYLLVGSCGQNAALPAFRVLVENEHRGSQTVSYTRAVRVEARGVKVAVRREYPGQVLVDDVLQYLPFQAADGQVQVFRQGRDAVVRTDFGLTVTYDWNARVTAKVPSSYAEALCGLCGNFNGDPADDLALRGGGQAANALAFGNSWQEETRPGCGATEPGDCPKLDSLVAQQLQSKNECGILADPKGPFRECHSKLDPQGAVRDCVYDRCLLPGQSGPLCDALATYAAACQAAGATVHPWRSEELCPLSCPPHSHYEACSYGCPLSCGDLPVPGGCGSECHEGCVCDEGFALSGESCLPLASCGCVHQGTYHPPGQTFYPGPGCDSLCHCQEGGLVSCESSSCGPHEACQPSGGSLGCVAVGSSTCQASGDPHYTTFDGRRFDFMGTCVYVLAQTCGTRPGLHRFAVLQENVAWGNGRVSVTRVITVQVANFTLRLEQRQWKVTVNGVDMKLPVVLANGQIRASQHGSDVVIETDFGLRVAYDLVYYVRVTVPGNYYQQMCGLCGNYNGDPKDDFQKPNGSQAGNANEFGNSWEEVVPDSPCLPPTPCPPGSEDCIPSHKCPPELEKKYQKEEFCGLLSSPTGPLSSCHKLVDPQGPLKDCIFDLCLGGGNLSILCSNIHAYVSACQAAGGHVEPWRTETFCPMECPPNSHYELCADTCSLGCSALSAPPQCQDGCAEGCQCDSGFLYNGQACVPIQQCGCYHNGVYYEPEQTVLIDNCRQQCTCHAGKGMVCQEHSCKPGQVCQPSGGILSCVTKGAELGLGLGLMRLGMEDKDSGAEGGVTGVSMAGVTLRSLAQTGVDVEGAAILYNGQPLKVLLPLLSPDPCHGVTCRPQETCKEQGGQGVCLPNYEATCWLWGDPHYHSFDGRKFDFQGTCNYVLATTGCPGVSTQGLTPFTVTTKNQNRGNPAVSYVRVVTVAALGTNISIHKDEIGKVRVNGVLTALPVSVADGRISVAQGASKALLVADFGLQVSYDWNWRVDVTLPSSYHGAVCGLCGNMDRNPNNDQVFPNGTLAPSIPIWGGSWRAPGWDPLCWDECRGSCPTCPEDRLEQYEGPGFCGPLASGTGGPFTTCHAHVPPESFFKGCVLDVCMGGGDRDILCKALASYVAACQAAGVVIEDWRAQVGCEITCPENSHYEVCGPPCPASCPSPAPLTTPAVCEGPCVEGCQCDAGFVLSADRCVPLNNGCGCWANGTYHEAGSEFWADGTCSQWCRCGPGGGSLVCTPASCGLGEVCGLLPSGQHGCQPVSTAECQAWGDPHYVTLDGHRFDFQGTCEYLLSAPCHGPPLGAENFTVTVANEHRGSQAVSYTRSVTLQIYNHSLTLSARWPRKLQVDGVFVALPFQLDSLLHAHLSGADVVVTTTSGLSLAFDGDSFVRLRVPAAYAASLCGLCGNYNQDPADDLKAVGGKPAGWQVGGAQGCGECVSKPCPSPCTPEQQESFGGPDACGVISATDGPLAPCHGLVPPAQYFQGCLLDACQVQGHPGGLCPAVATYVAACQAAGAQLGEWRRPDFCPLQCPAHSHYELCGDSCPVSCPSLSAPEGCESACREGCVCDAGFVLSGDTCVPVGQCGCLHDGRYYPLGEVFYPGPECERRCECGPGGHVTCQEGAACGPHEECRLEDGVQACHATGCGRCLANGGIHYITLDGRVYDLHGSCSYVLAQVCHPKPGDEDFSIVLEKNAAGDLQRLLVTVAGQVVSLAQGQQVTVDGEAVALPVAVGRVRVTAEGRNMVLQTTKGLRLLFDGDAHLLMSIPSPFRGRLCGLCGNFNGNWSDDFVLPNGSAASSVETFGAAWRAPGSSKGCGEGCGPQGCPVCLAEETAPYESNEACGQLRNPQGPFATCQAVLSPSEYFRQCVYDLCAQKGDKAFLCRSLAAYTAACQAAGVAVKPWRTDSFCPLHCPAHSHYSICTRTCQGSCAALSGLTGCTTRCFEGCECDDRFLLSQGVCIPVQDCGCTHNGRYLPVNSSLLTSDCSERCSCSSSSGLTCQAAGCPPGRVCEVKAEARNCWATRGLCVLSVGANLTTFDGARGATTSPGVYELSSRCPGLQNTIPWYRVVAEVQICHGKTEAVGQVHIFFQDGMVTLTPNKGVWVNGLRVDLPAEKLASVSVSRTPDGSLLVRQKAGVQVWLGANGKVAVIVSNDHAGKLCGACGNFDGDQTNDWHDSQEKPAMEKWRAQDFSPCYG

SEQ ID NO: 41 - DNA, 1095 bp, Homo sapiens
  CDS (363)..(806)
tccccgctctgctctgtccggtcacaggactttttgccctctgttcccgggtccctcaggcggccacccagtgggcacactcccaggcggcgctccggccccgcgctccctccctctgcctttcattcccagctgtcaacatcctggaagctttgaagctcaggaaagaagagaaatccactgagaacagtctgtaaaggtccgtagtgctatctacatccagacggtggaagggagagaaagagaaagaaggtatcctaggaatacctgcctgcttagaccctctataaaagctctgtgcatcctgccactgaggactccgaagaggtagcagtcttctgaaagacttcaactgtgaggacatgtcgttcagatttggccaacatctcatcaagccctctgtagtgtttctcaaaacagaactgtccttcgctcttgtgaataggaaacctgtggtaccaggacatgtccttgtgtgcccgctgcggccagtggagcgcttccatgacctgcgtcctgatgaagtggccgatttgtttcagacgacccagagagtcgggacagtggtggaaaaacatttccatgggacctctctcaccttttccatgcaggatggccccgaagccggacagactgtgaagcacgttcacgtccatgttcttcccaggaaggctggagactttcacaggaatgacagcatctatgaggagctccagaaacatgacaaggaggactttcctgcctcttggagatcagaggaggaaatggcagcagaagccgcagctctgcgggtctactttcagtgacacagatgtttttcagatcctgaattccagcaaaagagctattgccaaccagtttgaagaccgcccccccgcctctccccaagaggaactgaatcagcatgaaaatgcagtttcttcatctcaccatcctgtattcttcaaccagtgatcccccacctcggtcactccaactcccttaaaatacctagacctaaacggctcagacaggcagatttgaggtttccccctgtctccttattcggcagccttatgattaaacttccttctctgctgcaaaaaaaaaaaaaaa

SEQ ID NO: 42 - protein, 147 aa, Homo sapiens
MSFRFGQHLIKPSVVFLKTELSFALVNRKPVVPGHVLVCPLRPVERFHDLRPDEVADLFQTTQRVGTVVEKHFHGTSLTFSMQDGPEAGQTVKHVHVHVLPRKAGDFHRNDSIYEELQKHDKEDFPASWRSEEEMAAEAAALRVYFQ

SEQ ID NO: 43 - DNA, 1839 bp, Homo sapiens
  CDS (165)..(1448)
agcaacggggtgcggcagggtggggaacgcgggagcggggccagctcccaggaaagctggtctgcgagcggcccctgcccggctcccaggtccctgcgcgaccccgcccttcccgagaccccagccgggctgccgcccgcgtcccggaagctccagcctgaaccatgtttttcacttgtggcccaaatgaggccatggtggtctccgggttctgccgaagccccccagtcatggtggctggagggcgtgtctttgtcctgccctgcatccaacagatccagaggatctctctcaacacactgaccctcaatgtcaagagtgaaaaggtttacactcgccatggggtccccatctcagtcactggcattgcccaggtaaaaatccaggggcagaacaaggagatgttggcggccgcctgtcagatgttcctggggaagacggaggctgagattgcccacattgccctggagacgttagagggccaccagagggccatcatggcccacatgactgtggaggagatctataaggacaggcagaaattctcagaacaggttttcaaagtggcctcctcagacctggtcaacatgggcatcagtgtggttagctacactctgaaggacattcacgatgaccaggactatttgcactctttggggaaggctcgaacagctcaagtccaaaaagatgcacggattggagaagcagaggccaagagagatgctgggatccgggaagctaaagccaagcaggaaaaggtgtctgctcagtacctgagtgagatcgagatggccaaggcacagagagattacgaactgaagaaggccgcctatgacatcgaggtcaacacccgccgagcacaggctgacctggcctatcagcttcaggtggccaagactaagcagcagattgaggagcagcgggtgcaggtgcaggtggtggagcgggcccagcaggtggcagtgcaggagcaggagatcgcccggcgggagaaggagctggaggcccgggtgcggaagccagcggaagcggagcgctacaagctggagcgcctagccgaggcagagaagtcccaactaattatgcaggcggaggcagaagccgcgtctgtgcggatgcgtggggaagctgaggcctttgccataggggcccgagcccgagccgaggctgagcagatggccaagaaggcagaagccttccagctgtaccaagaggctgctcagctggacatgctgctagagaagctgccccaggtggcagaggagatcagtggtcccttgacttcagccaataagatcacactggtgtccagcggcagtgggaccatgggggcagccaaagtgactggggaagtactggacattctaactcgcctgccagagagtgtggaaagactcacaggcgtgagcatctcccaggtgaatcacaagcctttgagaacagcctgagccttcagccctcacagatgcccagcctcatagctgaagttgcctgaatgatcctcctgttgcatgtaacccactggcctccctgagcatgtccattgacagtgaggtcccacccctcatctctccttgccaaatagtttgtgccttgtcttgaagggggttgctccccttgccaacctcacactgctatgattgccaactccagcggtcccatgtcagccttctgatgatcccactccaccccacctcaacttatttaacttcctaattaaatcagactgtttgagcctgttgtctagaatattttcctgaccaagactgagggatgggctggaggttttcaactttgctacccaaataaattgctgtaagtaagtactaaaaaaaaaaa

SEQ ID NO: 44 - protein, 427 aa, Homo sapiens
MFFTCGPNEAMVVSGFCRSPPVMVAGGRVFVLPCIQQIQRISLNTLTLNVKSEKVYTRHGVPISVTGIAQVKIQGQNKEMLAAACQMFLGKTEAEIAHIALETLEGHQRAIMAHMTVEEIYKDRQKFSEQVFKVASSDLVNMGISVVSYTLKDIHDDQDYLHSLGKARTAQVQKDARIGEAEAKRDAGIREAKAKQEKVSAQYLSEIEMAKAQRDYELKKAAYDIEVNTRRAQADLAYQLQVAKTKQQIEEQRVQVQVVERAQQVAVQEQEIARREKELEARVRKPAEAERYKLERLAEAEKSQLIMQAEAEAASVRMRGEAEAFAIGARARAEAEQMAKKAEAFQLYQEAAQLDMLLEKLPQVAEEISGPLTSANKITLVSSGSGTMGAAKVTGEVLDILTRLPESVERLTGVSISQVNHKPLRTA

SEQ ID NO: 45 - DNA, 1869 bp, Homo sapiens
  CDS (189)..(1484)
gcacacactcatcgaaaaaaatttggattattagaagagagaggtctgcggcttccacaccgtacagcgtggtttttcttctcggtataaaagcaaagttgtttttgatacgtgacagtttcccacaagccaggctgatccttttctgtcagtccacttcaccaagcctgcccttggacaaggacccgatgcccaaccccaggcctggcaagccctcggccccttccttggcccttggcccatccccaggagcctcgcccagctggagggctgcacccaaagcctcagacctgctgggggcccggggcccagggggaaccttccagggccgagatcttcgaggcggggcccatgcctcctcttcttccttgaaccccatgccaccatcgcagctgcagctgcccacactgcccctagtcatggtggcaccctccggggcacggctgggccccttgccccacttacaggcactcctccaggacaggccacatttcatgcaccagctctcaacggtggatgcccacgcccggacccctgtgctgcaggtgcaccccctggagagcccagccatgatcagcctcacaccacccaccaccgccactggggtcttctccctcaaggcccggcctggcctcccacctgggatcaacgtggccagcctggaatgggtgtccagggagccggcactgctctgcaccttcccaaatcccagtgcacccaggaaggacagcaccctttcggctgtgccccagagctcctacccactgctggcaaatggtgtctgcaagtggcccggatgtgagaaggtcttcgaagagccagaggacttcctcaagcactgccaggcggaccatcttctggatgagaagggcagggcacaatgtctcctccagagagagatggtacagtctctggagcagcagctggtgctggagaaggagaagctgagtgccatgcaggcccacctggctgggaaaatggcactgaccaaggcttcatctgtggcatcatccgacaagggctcctgctgcatcgtagctgctggcagccaaggccctgtcgtcccagcctggtctggcccccgggaggcccctgacagcctgtttgctgtccggaggcacctgtggggtagccatggaaacagcacattcccagagttcctccacaacatggactacttcaagttccacaacatgcgaccccctttcacctacgccacgctcatccgctgggccatcctggaggctccagagaagcagcggacactcaatgagatctaccactggttcacacgcatgtttgccttcttcagaaaccatcctgccacctggaagaacgccatccgccacaacctgagtctgcacaagtgctttgtgcgggtggagagcgagaagggggctgtgtggaccgtggatgagctggagttccgcaagaaacggagccagaggcccagcaggtgttccaaccctacacctggcccctgacctcaagatcaaggaaaggaggatggacgaacaggggccaaactggtgggaggcagaggtggtgggggcagggatgataggccctggatgtgcccacagggaccaagaagtgaggtttccactgtcttgcctgccagggcccctgttcccccgctggcagccaccccctcccccatcatatcctttgccccaaggctgctcagaggggccccggtcctggccccagcccccacctccgccccagacacaccccccagtcgagccctgcagccaaacagagccttcacaaccagccacacagagcctgcctcagctgctcgcacagattacttcagggctggaaaagtcacacagacacacaaaatgtcacaatcctgtccctcac

SEQ ID NO: 46 - protein, 431 aa, Homo sapiens
MPNPRPGKPSAPSLALGPSPGASPSWRAAPKASDLLGARGPGGTFQGRDLRGGAHASSSSLNPMPPSQLQLPTLPLVMVAPSGARLGPLPHLQALLQDRPHFMHQLSTVDAHARTPVLQVHPLESPAMISLTPPTTATGVFSLKARPGLPPGINVASLEWVSREPALLCTFPNPSAPRKDSTLSAVPQSSYPLLANGVCKWPGCEKVFEEPEDFLKHCQADHLLDEKGRAQCLLQREMVQSLEQQLVLEKEKLSAMQAHLAGKMALTKASSVASSDKGSCCIVAAGSQGPVVPAWSGPREAPDSLFAVRRHLWGSHGNSTFPEFLHNMDYFKFHNMRPPFTYATLIRWAILEAPEKQRTLNEIYHWFTRMFAFFRNHPATWKNAIRHNLSLHKCFVRVESEKGAVWTVDELEFRKKRSQRPSRCSNPTPGP

SEQ ID NO: 47 - DNA, 738 bp, Homo sapiens
  CDS (129)..(566)
gtatctgtggtaaacccagtgacacgggggagatgacatacaaaaagggcaggacctgagaaagattaagctgcaggctccctgcccataaaacagggtgtgaaaggcatctcagcggctgccccaccatggctacctgggccctcctgctccttgcagccatgctcctgggcaacccaggtctggtcttctctcgtctgagccctgagtactacgacctggcaagagcccacctgcgtgatgaggagaaatcctgcccgtgcctggcccaggagggcccccagggtgacctgttgaccaaaacacaggagctgggccgtgactacaggacctgtctgacgatagtccaaaaactgaagaagatggtggataagcccacccagagaagtgtttccaatgctgcgacccgggtgtgtaggacggggaggtcacgatggcgcgacgtctgcagaaatttcatgaggaggtatcagtctagagttacccagggcctcgtggccggagaaactgcccagcagatctgtgaggacctcaggttgtgtataccttctacaggtcccctctgagccctctcaccttgtcctgtggaagaagcacaggctcctgtcctcagatcccgggaacctcagcaacctctgccggctcctcgcttcctcgatccagaatccactctccagtctccctcccctgactccctctgctgtcctcccctctcacgagaataaagtgtcaagcaag

SEQ ID NO: 48 - protein, 145 aa, Homo sapiens
MATWALLLLAAMLLGNPGLVFSRLSPEYYDLARAHLRDEEKSCPCLAQEGPQGDLLTKTQELGRDYRTCLTIVQKLKKMVDKPTQRSVSNAATRVCRTGRSRWRDVCRNFMRRYQSRVTQGLVAGETAQQICEDLRLCIPSTGPL

SEQ ID NO: 49 - DNA, 853 bp, Homo sapiens
  CDS (281)..(670)
cctgggccctcctgctccttgcagccatgctcctgggcaacccagcccctgcctccgcatctgcgtggtgaaggccattggcctcatcggtggatctgcgtttcctcgggcccacactgtctaggattgtgcggggctggtgagagaacaagatctcttccgtgttcaaggcagacttcctgccccctgcaccctgctctctcccgggccttgaggtcagtgtgagccccaagggcaagaacacttctggaagggagagtggatttggctgggcctctggatggaaggtctggtcttctctcgtctgagccctgagtactacgacccggcaagagcccacctgcgtgatggggagaaatcctgcccgtgcgggcaggagggcccccagggtgacctgttgaccaaaacacaggagctgggccgtgactacaggacctgtctgacgatagtccaaaaactgaagaagatggtggataagcccacccagagaagtgtttccaatgctgcgacccgggtgtgtaggacggggaggtcacgatggcgcgacgtctgcagaaatttcatgaggaggtatcagtctagagttatccaaggcctcgtggccggagaaactgcccagcagatctgtgaggacctcaggttgtgtataccttctacaggtcccctctgagccctctcaccttgtcctgtggaagaagcacaggctcctgtcctcagatcccgggaacgtcagcaacctctgccggctcctcgcttcctcgatccagaatccactctccagtctccctcccctgactccctctgctgtcctcccctctcaggggaataaagtgtcaagcaagattttagccgc

SEQ ID NO: 50 - protein, 129 aa, Homo sapiens
MEGLVFSRLSPEYYDPARAHLRDGEKSCPCGQEGPQGDLLTKTQELGRDYRTCLTIVQKLKKMVDKPTQRSVSNAATRVCRTGRSRWRDVCRNFMRRYQSRVIQGLVAGETAQQICEDLRLCIPSTGPL

SEQ ID NO: 51 - DNA, 2268 bp, Homo sapiens
  CDS (68)..(1519)
gctgcaggaagcagcaggagacgcccggcagccgggacggtcggggacgcctgaagaagaagaaaacatgtcaggacacaaatgcagttatccctgggacttacaggatcgatatgctcaagataagtcagttgtaaataagatgcaacagaaatattgggagacgaagcaggcctttattaaagccacagggaagaaggaagatgaacatgttgttgcctctgacgcggacctggatgccaagctagagctgtttcattcaattcagagaacctgtctggacttatcgaaagcaattgtactctatcaaaagaggatatgtttcttgtctcaagaagaaaacgaactgggaaaatttcttcgatcccaaggtttccaagataaaaccagagcaggaaagatgatgcaagcgacaggaaaggccctctgcttttcttcccagcaaaggttggccttacgaaatcctttgtgtcgatttcaccaagaagtggagacttttcggcatcgggccatctcagatacttggctgacggtgaaccgcatggaacagtgcaggacggaatatagaggagcactattatggatgaaggacgtgtctcaggagcttgatccagacctctacaagcaaatggagaagttcaggaaggtacaaacacaagtgcgccttgcaaaaaaaaactttgacaaattgaagatggatgtttgtcaaaaagtggatcttcttggagcgagcagatgcaatctcttgtctcacatgctagcaacataccagaccactctgcttcatttttgggagaaaacttctcacactatggcagccatccatgagagtttcaaaggttatcaaccatatgaatttactactttaaagagcttacaagaccctatgaaaaaattagttgagaaagaagagaagaagaaaatcaaccagcaggaaagtacagatgcagccgtgcaggagccgagccaattaatttcattagaggaagaaaaccagcgcaaggaatcctctagttttaagactgaagatggaaaaagtattttatctgccttagacaaaggctctacacatactgcatgctcaggacccatagatgaactattagacatgaaatctgaggaaggtgcttgcctgggaccagtggcagggaccccggaacctgaaggtgctgacaaagatgacctgctgctgttgagtgagatcttcaatgcttcctccttggaagagggcgagttcagcaaagagtgggccgctgtgtttggagacggccaagtgaaggagccagtgcccactatggccctgggagagccagaccccaaggcccagacaggctcaggtttccttccttcgcagcttttagaccaaaatatgaaagacttacaggcctcgctacaagaacctgctaaggctgcctcagacctgactgcctggttcagcctcttcgctgacctcgacccactctcaaatcctgatgctgttgggaaaaccgataaagaacacgaattgctcaatgcatgaatctgtacccttcgggagggcactcacatgccgcccccagcagctcccctgggggctagcagaagtataaagtgatcagtatgctgttttaataattatgtgccattttaataaaatgaaagggtcaacggccctgtttatattggtataattatttactcttatttggtataaagggttttcgtgtatctctatgtggatctaaataatacaggattgtctagaagcggtttccaggccaccgctctcctgcctacatcccatcatggctgctgcggtgtcactgggctaccgtgagatccaagttgaaatcagaagcctactttgatggtaggtttgaatgacgtgtcctacagcctcagaggcagcaggaggctagcaaagcttaaatgcctccttctctgcccccagcctctgtcccccttggaggagggctgtaggaagattccctcttcctgccaagccaccttccagtgagctctggatgaagctctggccaaccaaagacactgtccccacagcaggtgcctggtgggccacgtgttctcacactggtggaggagctgggcttctgtccaaggcacaaaccttactatggaaagcagccatatttgcagataccactgtctccttttgtcctcttcgtggctggaattcaaaagcatgtatttctgaagcctcttgtgacattgttttttttttttttttaattaaacagaaaagatatttgacatgcaaaaaaaaaaaaa

SEQ ID NO: 52 - protein, 483 aa, Homo sapiens
MSGHKCSYPWDLQDRYAQDKSVVNKMQQKYWETKQAFIKATGKKEDEHVVASDADLDAKLELFHSIQRTCLDLSKAIVLYQKRICFLSQEENELGKFLRSQGFQDKTRAGKMMQATGKALCFSSQQRLALRNPLCRFHQEVETFRHRAISDTWLTVNRMEQCRTEYRGALLWMKDVSQELDPDLYKQMEKFRKVQTQVRLAKKNFDKLKMDVCQKVDLLGASRCNLLSHMLATYQTTLLHFWEKTSHTMAAIHESFKGYQPYEFTTLKSLQDPMKKLVEKEEKKKINQQESTDAAVQEPSQLISLEEENQRKESSSFKTEDGKSILSALDKGSTHTACSGPIDELLDMKSEEGACLGPVAGTPEPEGADKDDLLLLSEIFNASSLEEGEFSKEWAAVFGDGQVKEPVPTMALGEPDPKAQTGSGFLPSQLLDQNMKDLQASLQEPAKAASDLTAWFSLFADLDPLSNPDAVGKTDKEHELLNA

SEQ ID NO: 53 - DNA, 2396 bp, Homo sapiens
  CDS (196)..(1647)
actctgggcggcggatccgagcgggggataccccaggagatgggggtcgaggagagaccccggggagtagagagagagaaactcactccccgagtccccgaccctccccaagcaaggttataatataacttatcctctcatgcttttttcctgccccttctccccaaatcatcaacaatagaagaagaagaaaacatgtcaggacacaaatgcagttatccctgggacttacaggatcgatatgctcaagataagtcagttgtaaataagatgcaacagaaatattgggagacgaagcaggcctttattaaagccacagggaagaaggaagatgaacatgttgttgcctctgacgcggacctggatgccaagctagagctgtttcattcaattcagagaacctgtctggacttatcgaaagcaattgtactctatcaaaagaggatatgtttcttgtctcaagaagaaaacgaactgggaaaatttcttcgatcccaaggtttccaagataaaaccagagcaggaaagatgatgcaagcgacaggaaaggccctctgcttttcttcccagcaaaggttggccttacgaaatcctttgtgtcgatttcaccaagaagtggagacttttcggcatcgggccatctcagatacttggctgacggtgaaccgcatggaacagtgcaggacggaatatagaggagcactattatggatgaaggacgtgtctcaggagcttgatccagacctctacaagcaaatggagaagttcaggaaggtacaaacacaagtgcgccttgcaaaaaaaaactttgacaaattgaagatggatgtttgtcaaaaagtggatcttcttggagcgagcagatgcaatctcttgtctcacatgctagcaacataccagaccactctgcttcatttttgggagaaaacttctcacactatggcagccatccatgagagtttcaaaggttatcaaccatatgaatttactactttaaagagcttacaagaccctatgaaaaaattagttgagaaagaagagaagaagaaaatcaaccagcaggaaagtacagatgcagccgtgcaggagccgagccaattaatttcattagaggaagaaaaccagcgcaaggaatcctctagttttaagactgaagatggaaaaagtattttatctgccttagacaaaggctctacacatactgcatgctcaggacccatagatgaactattagacatgaaatctgaggaaggtgcttgcctgggaccagtggcagggaccccggaacctgaaggtgctgacaaagatgacctgctgctgttgagtgagatcttcaatgcttcctccttggaagagggcgagttcagcaaagagtgggccgctgtgtttggagacggccaagtgaaggagccagtgcccactatggccctgggagagccagaccccaaggcccagacaggctcaggtttccttccttcgcagcttttagaccaaaatatgaaagacttacaggcctcgctacaagaacctgctaaggctgcctcagacctgactgcctggttcagcctcttcgctgacctcgacccactctcaaatcctgatgctgttgggaaaaccgataaagaacacgaattgctcaatgcatgaatctgtacccttcgggagggcactcacatgccgcccccagcagctcccctgggggctagcagaagtataaagtgatcagtatgctgttttaataattatgtgccattttaataaaatgaaagggtcaacggccctgtttatattggtataattatttactcttatttggtataaagggttttcgtgtatctctatgtggatctaaataatacaggattgtctagaagcggtttccaggccaccgctctcctgcctacatcccatcatggctgctgcggtgtcactgggctaccgtgagatccaagttgaaatcagaagcctactttgatggtaggtttgaatgacgtgtcctacagcctcagaggcagcaggaggctagcaaagcttaaatgcctccttctctgcccccagcctctgtcccccttggaggagggctgtaggaagattccctcttcctgccaagccaccttccagtgagctctggatgaagctctggccaaccaaagacactgtccccacagcaggtgcctggtgggccacgtgttctcacactggtggaggagctgggcttctgtccaaggcacaaaccttactatggaaagcagccatatttgcagataccactgtctccttttgtcctcttcgtggctggaattcaaaagcatgtatttctgaagcctcttgtgacattgttttttttttttttttaattaaacagaaaagatatttgacatgcaaaaaaaaaaaaa

SEQ ID NO: 54 - protein, 483 aa, Homo sapiens; identical to SEQ ID NO: 52

SEQ ID NO: 55 - DNA, 1809 bp, Homo sapiens
  CDS (90)..(1469)
gtcttcctccctccctcccttcctcttactctcattcatttcatacacactggctcacacatctactctctctctctatctctctcagaatgacaattctaggtacaacttttggcatggttttttctttacttcaagtcgtttctggagaaagtggctatgctcaaaatggagacttggaagatgcagaactggatgactactcattctcatgctatagccagttggaagtgaatggatcgcagcactcactgacctgtgcttttgaggacccagatgtcaacatcaccaatctggaatttgaaatatgtggggccctcgtggaggtaaagtgcctgaatttcaggaaactacaagagatatatttcatcgagacaaagaaattcttactgattggaaagagcaatatatgtgtgaaggttggagaaaagagtctaacctgcaaaaaaatagacctaaccactatagttaaacctgaggctccttttgacctgagtgtcgtctatcgggaaggagccaatgactttgtggtgacatttaatacatcacacttgcaaaagaagtatgtaaaagttttaatgcacgatgtagcttaccgccaggaaaaggatgaaaacaaatggacgcatgtgaatttatccagcacaaagctgacactcctgcagagaaagctccaaccggcagcaatgtatgagattaaagttcgatccatccctgatcactattttaaaggcttctggagtgaatggagtccaagttattacttcagaactccagagatcaataatagctcaggggagatggatcctatcttactaaccatcagcattttgagttttttctctgtcgctctgttggtcatcttggcctgtgtgttatggaaaaaaaggattaagcctatcgtatggcccagtctccccgatcataagaagactctggaacatctttgtaagaaaccaagaaaaaatttaaatgtgagtttcaatcctgaaagtttcctggactgccagattcatagggtggatgacattcaagctagagatgaagtggaaggttttctgcaagatacgtttcctcagcaactagaagaatctgagaagcagaggcttggaggggatgtgcagagccccaactgcccatctgaggatgtagtcatcactccagaaagctttggaagagattcatccctcacatgcctggctgggaatgtcagtgcatgtgacgcccctattctctcctcttccaggtccctagactgcagggagagtggcaagaatgggcctcatgtgtaccaggacctcctgcttagccttgggactacaaacagcacgctgccccctccattttctctccaatctggaatcctgacattgaacccagttgctcagggtcagcccattcttacttccctgggatcaaatcaagaagaagcatatgtcaccatgtccagcttctaccaaaaccagtgaagtgtaagaaacccagactgaacttaccgtgagcgacaaagatgatttaaaagggaagtctagagttcctagtctccctcacagcacagagaagacaaaattagcaaaaccccactacacagtctgcaagattctgaaacattgctttgaccactcttcctgagttcagtggcactcaacatgagtcaagagcatcctgcttctaccatgtggatttggtcacaaggtttaaggtgacccaatgattcagctatttaaaaaaaaaagaggaaagaatgaaagagtaaaggaaatgattgaggagtgaggaaggcaggaagagagcatgagaggaaaaaaa

SEQ ID NO: 56 - protein, 459 aa, Homo sapiens
MTILGTTFGMVFSLLQVVSGESGYAQNGDLEDAELDDYSFSCYSQLEVNGSQHSLTCAFEDPDVNITNLEFEICGALVEVKCLNFRKLQEIYFIETKKFLLIGKSNICVKVGEKSLTCKKIDLTTIVKPEAPFDLSVVYREGANDFVVTFNTSHLQKKYVKVLMHDVAYRQEKDENKWTHVNLSSTKLTLLQRKLQPAAMYEIKVRSIPDHYFKGFWSEWSPSYYFRTPEINNSSGEMDPILLTISILSFFSVALLVILACVLWKKRIKPIVWPSLPDHKKTLEHLCKKPRKNLNVSFNPESFLDCQIHRVDDIQARDEVEGFLQDTFPQQLEESEKQRLGGDVQSPNCPSEDVVITPESFGRDSSLTCLAGNVSACDAPILSSSRSLDCRESGKNGPHVYQDLLLSLGTTNSTLPPPFSLQSGILTLNPVAQGQPILTSLGSNQEEAYVTMSSFYQNQ

SEQ ID NO: 57 - DNA, 3649 bp, Homo sapiens
  CDS (75)..(1811)
agtcccagcccaagggtagctggaggcgcgcaggccggctccgctccggccccggacgatgcggcgcgcccaggatgctgccgtgcctcgtagtgctgctggcggcgctcctcagcctccgtcttggctcagacgctcatgggacagagctgcccagccctccgtctgtgtggtttgaagcagaatttttccaccacatcctccactggacacccatcccaaatcagtctgaaagtacctgctatgaagtggcgctcctgaggtatggaatagagtcctggaactccatctccaactgtagccagaccctgtcctatgaccttaccgcagtgaccttggacctgtaccacagcaatggctaccgggccagagtgcgggctgtggacggcagccggcactccaactggaccgtcaccaacacccgcttctctgtggatgaagtgactctgacagttggcagtgtgaacctagagatccacaatggcttcatcctcgggaagattcagctacccaggcccaagatggcccccgcaaatgacacatatgaaagcatcttcagtcacttccgagagtatgagattgccattcgcaaggtgccgggaaacttcacgttcacacacaagaaagtaaaacatgaaaacttcagcctcctaacctctggagaagtgggagagttctgtgtccaggtgaaaccatctgtcgcttcccgaagtaacaaggggatgtggtctaaagaggagtgcatctccctcaccaggcagtatttcaccgtgaccaacgtcatcatcttctttgcctttgtcctgctgctctccggagccctcgcctactgcctggccctccagctgtatgtgcggcgccgaaagaagctacccagtgtcctgctcttcaagaagcccagccccttcatcttcatcagccagcgtccctccccagagacccaagacaccatccacccgcttgatgaggaggcctttttgaaggtgtccccagagctgaagaacttggacctgcacggcagcacagacagtggctttggcagcaccaagccatccctgcagactgaagagccccagttcctcctccctgaccctcacccccaggctgacagaacgctgggaaacggggagccccctgtgctgggggacagctgcagtagtggcagcagcaatagcacagacagcgggatctgcctgcaggagcccagcctgagccccagcacagggcccacctgggagcaacaggtggggagcaacagcaggggccaggatgacagtggcattgacttagttcaaaactctgagggccgggctggggacacacagggtggctcggccttgggccaccacagtcccccggagcctgaggtgcctggggaagaagacccagctgctgtggcattccagggttacctgaggcagaccagatgtgctgaagagaaggcaaccaagacaggctgcctggaggaagaatcgcccttgacagatggccttggccccaaattcgggagatgcctggttgatgaggcaggcttgcatccaccagccctggccaagggctatttgaaacaggatcctctagaaatgactctggcttcctcaggggccccaacgggacagtggaaccagcccactgaggaatggtcactcctggccttgagcagctgcagtgacctgggaatatctgactggagctttgcccatgaccttgcccctctaggctgtgtggcagccccaggtggtctcctgggcagctttaactcagacctggtcaccctgcccctcatctctagcctgcagtcaagtgagtgactcgggctgagaggctgcttttgattttagccatgcctgctcctctgcctggaccaggaggagggcccctggggcagaagttaggcacgaggcagtctgggcacttttctgcaagtccactggggctggccccagccaggccctgcagggctggtcagggtgtctggggcaggaggaggccaactcactgaactagtgcagggtatgtgggtggcactgacctgttctgttgactggggccctgcagactctggcagagctgagaagggcagggaccttctccctcctaggaactctttcctgtatcataaaggattatttgctcaggggaaccatggggctttctggagttgtggtgaggccaccaggctgaagtcagctcagacccagacctccctgcttaggccactcgagcatcagagcttccagcaggaggaagggctgtaggaatggaagcttcagggccttgctgctggggtcatttttaggggaaaaaggaggatatgatggtcacatggggaacctcccctcatcgggcctctggggcaggaagcttgtcactggaagatcttaaggtatatattttctggacactcaaacacatcataatggattcactgaggggagacaaagggagccgagaccctggatggggcttccagctcagaacccatccctctggtgggtacctctggcacccatctgcaaatatctccctctctccaacaaatggagtagcatccccctggggcacttgctgaggccaagccactcacatcctcactttgctgccccaccatcttgctgacaacttccagagaagccatggttttttgtattggtcataactcagccctttgggcggcctctgggcttgggcaccagctcatgccagccccagagggtcagggttggaggcctgtgcttgtgtttgctgctaatgtccagctacagacccagaggataagccactgggcactgggctggggtccctgccttgttggtgttcagctgtgtgattttggactagccacttgtcagagggcctcaatctcccatctgtgaaataaggactccacctttaggggaccctccatgtttgctgggtattagccaagctggtcctgggagaatgcagatactgtccgtggactaccaagctggcttgtttcttatgccagaggctaacagatccaatgggagtccatggtgtcatgccaagacagtatcagacacagccccagaagggggcattatgggccctgcctccccataggccatttggactctgccttcaaacaaaggcagttcagtccacaggcatggaagctgtgaggggacaggcctgtgcgtgccatccagagtcatctcagccctgcctttctctggagcattctgaaaacagatattctggcccagggaatccagccatgacccccacccctctgccaaagtactcttaggtgccagtctggtaactgaactccctctggaggcaggcttgagggaggattcctcagggttcccttgaaagctttatttatttattttgttcatttatttattggagaggcagcattgcacagtgaaagaattctggatatctcaggagccccgaaattctagctctgactttgctgtttccagtggtatgaccttggagaagtcacttatcctcttggagcctcagtttcctcatctgcagaataatgactgacttgtctaattcgtagggatgtgaggttctgctgaggaaatgggtatgaatgtgccttgaacacaaagctctgtcaataagtgatacatgttttttattccaataaattgtcaagaccaca

SEQ ID NO: 58 - protein, 578 aa, Homo sapiens
MLPCLVVLLAALLSLRLGSDAHGTELPSPPSVWFEAEFFHHILHWTPIPNQSESTCYEVALLRYGIESWNSISNCSQTLSYDLTAVTLDLYHSNGYRARVRAVDGSRHSNWTVTNTRFSVDEVTLTVGSVNLEIHNGFILGKIQLPRPKMAPANDTYESIFSHFREYEIAIRKVPGNFTFTHKKVKHENFSLLTSGEVGEFCVQVKPSVASRSNKGMWSKEECISLTRQYFTVTNVIIFFAFVLLLSGALAYCLALQLYVRRRKKLPSVLLFKKPSPFIFISQRPSPETQDTIHPLDEEAFLKVSPELKNLDLHGSTDSGFGSTKPSLQTEEPQFLLPDPHPQADRTLGNGEPPVLGDSCSSGSSNSTDSGICLQEPSLSPSTGPTWEQQVGSNSRGQDDSGIDLVQNSEGRAGDTQGGSALGHHSPPEPEVPGEEDPAAVAFQGYLRQTRCAEEKATKTGCLEEESPLTDGLGPKFGRCLVDEAGLHPPALAKGYLKQDPLEMTLASSGAPTGQWNQPTEEWSLLALSSCSDLGISDWSFAHDLAPLGCVAAPGGLLGSFNSDLVTLPLISSLQSSE

SEQ ID NO: 59 - DNA, 5334 bp, Homo sapiens
  CDS (56)..(2353)
gatcgaggagctctccaggtcgtcccgggagaggctgctgcagtcccgggacaggatgttctccaagttcacctccatcctgcagcacgccgtggaggcgcttgcaccttctcttcctttacaagaagattttgtttatcactggaaggcaattacccattactacatagggacttcagatgataaagccccagtgaccgatacaaatattccatcgcatctggaacagatgttagatatactggttcaagaagaaaatgaacgggaatctggagagacagggccatgtatggaatatttgcttcatcacaagatcttggaaacattatataccttggggaaagctgattgtcctccgggaatgaaacagcaggttttggttttctatacgaaacttctgggaagaatccggcggccactacttccacacattaacgtgcacaggccagtgcagaaattaattagactctgtggtgaagtcctagcaacaccaacagaaaatgaagagattcagtttctttgcattgtgtgtgcgaagctgaaacaggacccctacctggttaactttttcctagagaataagatgaaatcattggcttccaaaggagtaccaaatgtaatttcagaagatacattaaaaggtcaggattccttgtcaacagatacaggacagtcccgtcaaccagaggaactatctggtgctactggaatggagcaaacagaattggaagatgagcctcctcatcagatggatcacctgtccacaagcttggataacctcagtgtcacctcactgccagaggcctcggttgtttgtccaaatcaggattacaatttagtgaattctttgttaaatcttactagaagtcctgatggcagaatagctgtgaaggcatgtgaaggcttgatgctgttagtaagtttgccagagcctgcggctgcaaagtgccttacacagagcacttgcttgtgtgaactactgacagacagacttgcctccctgtacaaggccctacctcagtcagtggatccgttagatattgaaaccgtggaagcaattaactggggcttggactcatatagtcataaagaagatgcttcagcatttccaggaaaacgagccttaatttcatttctttcctggtttgattattgtgatcagctcattaaggaagcccaaaagactgctgctgttgctcttgccaaagctgttcatgaaagatttttcattggtgttatggaacctcaattaatgcaaacttctgagatgggtattctcacatccactgctctgcttcatcgcatcgttcggcaagtgacctctgatgttttgcttcaagaaatggtgttttttatccttggagaacagagggaaccagaaactctggcagaaatcagcagacatcctttaaggcataggttaattgaacattgtgatcacatatctgatgagataagcataatgacattacgaatgtttgaacatcttttacaaaaacccaatgagcacattctttacaacttggtcttgagaaatcttgaagaaagaaattatacagaatataaacctttgtgcccagaagataaagatgtggtagaaaatggattgatagcaggagcagtagatctggaagaagatccattatttactgacatttcaccagaaaacactttgccaaaccaagagtggcttagttcttcacctcctgctactccagaccaccccaaaaatgatggaaaaactgaagttcataaaattgtaaatagttttctctgtctggtaccggatgacgcaaaatcctcctaccatgttgagggcacaggatatgacacttacctccgagacgctcatgggcagttccgagactactgtgctatctgcttaagatgggagtggcctgggtctccaaaagcattggaaaagtgcaatttagaagctgctttctttgaaggtcattttttgaaagtgctgttcgacagaatgggaagaattcttgatcagccatatgatgtaaacttacaagtaacctcagtgttatctagactttctctcttccctcatccacacatccacgagtaccttttggatccttacgtgaacctcgctcctggctgtagatctctcttctctgtaattgtcagggttgttggagaccttatgcttcgaatccagcgtattcaagactttactcccaagcttctgttagtcagaaagcggttacttggtttggagcctgaaggccctattattgaccacatcacactgctagagggtgtgattgtgttagaagagttctgtaaggagctggcggcaatcgcatttgtaaaatatcatgcttcctccacaccataaataacatctttcatgtaactgggggaacagaactactgtgtacatttcaccaaaaaagactcagttccacccagccacaagaggataaaaagcctttttaaacgcagtattgctgtaaactggacagaaccattaagaacctattgagtggacattcttggtgaaatgttgtataatgttgttttcattggctttatcataatggttctatatatacaattgcacattgttgaatccaggatacaatcaaaggaacttcaggaaataagcatttctaatgactgtgaaaagctgcaatatttccaatgtcatgactttgatgatatttctgttatattaatgtccttttaggtagcaaggcattttgacattctctgggactcaaatgcttgtattcttttggattaataagtagcaaaaaaaaatcactaattttataactttttaaggtcagaattcttatcaaacaaaatatgaaaactgtaaatgagaaaaaaatacaattcagaaaccattgaatgaattaattataggcgataaaaatgtgtagagcaccattaactttcttcagcttttttaagaataacaatttaatatgataaattcttgattaatataatatatctatatttttaaagaaatgttcttttactcttttgtgcacatagccatgttagtgattttcttcatgtgtgggtcccagtttatttaaactgtgtcgttttcgcagcagtgttcaatttgctcaccattggtagtgtttgctaaaattgtatttttttaagctaagtaacatgtactgggttgagaacctttttcccccctctccctctcagaaaattgctttataaaattgctttataatttgattttcttactgaaacgcatggtggtgtctaggtggggaactgactgataacccttggcagcaatcaaagtgccagtggctcctcgatgtttacatttttttctattttgttcagtcttttgttttaaatgattctaaagagattaaagaaaacagagttttaaatgtcctatttacatgttaaaggatttggggaaattgggtatgtatgtgaatgggtgtacatgtaggaacctgtagttcagcaaagctgcgctgggcacagcatgcttgtacttgattgacaaaatcgtgtttgccagtccactttctatttttcctttaagtgatgctgatcactcaaataatgcttttaagctattgtttgtttttatttgacatgttaagccgcagcactttcttcttcatctttccatttactgatatttgggggaacaggctatcaaaggttccggcttgaagggaactgtcactaccccctctaggaagttattttatgtagcatgtttgcatatacgcattgtgtggcatgtgcatagaggcttgttttacacctatctgctcattttgttgtgttagcttttctggtttatttcatagtttgttcttgctatttattaagaacagaatatcaaaagattatgaatagcctcagctctagaatgcttaccactgttaaaacaacaaaaagactaaacctctaatttcatgcaaatctttgttagcttattctaagaaatttattaagtaaaacaaagaaaaaacagaagtgggagatagttattttgtgcgtaattttctttaaatcattttgaatgatgtgaaggcattcagtttgctgtatttttttaatcacttcatacaaggaaaacttcgacatttacatttctagatgtagtaacagtctactttgatatatgagtatttaaactaaggcattaagagatattagatatttcttaatgttttcatagtgctcaataggtgtagtagcaatgatattacctctgaaaccaaatactcttttatccttgattccactatgggaccttataactagtccatgaaaccaagctcagaaaagctttaactcttatatttgtgtatatgtatgctgcttctgaaaatataatttttctaagttgttgtaatgactttaatttgtaatcagctaaggcttaagatttcatttgtttctaagtttctgtttttcatcccttcttttttcttttatatttagttcagacctagagccagtagaagctctcacagtgagttcaatttgttagtgaaacattgtactgcatcaccagtttttcttaccttctgttgacagctgaatatttctgttactcagtacttgcaaaaacagtaactaaaatgcactatgctgagtggaaagcaccgtcataacaattgattgccatagcaagttccaaagtgaatttcagccttgcttcacatttgtatcaataaatatgcacattttttaaaactttctaacaatatagtctttggatttgtttttagttatgagccgcattctttacttgatagaactcagatttgtcttagcctattgccatatagtactcaccttataactatgtaactttctcgtaatgtatctgtttgtgcaatatggaagctgtgagtggattcatagctttttggtttaattgtacattattgtgtgtgtatatatgtatatatgtatatatataaggaccaaaattcttagctcgcttacactgttgctagtgtaaacattgttacacttaattttacagggcacaaattatggaattacttcataaattcatggtaatgttttcataaattattgcattaacatacaattgccatttaattatgaagtccatcagtattgacagaagacgttacagtgaagtgctaaaaccacactatatggtaattatattttgggttatgtagtaaatcaaatatgcatgtcattgtgacactttatgtgttaaaacatggtagataatcacattttctgggccctgtaaaatagtgttactgtaatactctgttttgcctcctgccttgtttacattaaacaggatatttggtaaaaaaaaaaaaaaaa

SEQ ID NO: 60 - protein, 765 aa, Homo sapiens
MFSKFTSILQHAVEALAPSLPLQEDFVYHWKAITHYYIGTSDDKAPVTDTNIPSHLEQMLDILVQEENERESGETGPCMEYLLHHKILETLYTLGKADCPPGMKQQVLVFYTKLLGRIRRPLLPHINVHRPVQKLIRLCGEVLATPTENEEIQFLCIVCAKLKQDPYLVNFFLENKMKSLASKGVPNVISEDTLKGQDSLSTDTGQSRQPEELSGATGMEQTELEDEPPHQMDHLSTSLDNLSVTSLPEASVVCPNQDYNLVNSLLNLTRSPDGRIAVKACEGLMLLVSLPEPAAAKCLTQSTCLCELLTDRLASLYKALPQSVDPLDIETVEAINWGLDSYSHKEDASAFPGKRALISFLSWFDYCDQLIKEAQKTAAVALAKAVHERFFIGVMEPQLMQTSEMGILTSTALLHRIVRQVTSDVLLQEMVFFILGEQREPETLAEISRHPLRHRLIEHCDHISDEISIMTLRMFEHLLQKPNEHILYNLVLRNLEERNYTEYKPLCPEDKDVVENGLIAGAVDLEEDPLFTDISPENTLPNQEWLSSSPPATPDHPKNDGKTEVHKIVNSFLCLVPDDAKSSYHVEGTGYDTYLRDAHGQFRDYCAICLRWEWPGSPKALEKCNLEAAFFEGHFLKVLFDRMGRILDQPYDVNLQVTSVLSRLSLFPHPHIHEYLLDPYVNLAPGCRSLFSVIVRVVGDLMLRIQRIQDFTPKLLLVRKRLLGLEPEGPIIDHITLLEGVIVLEEFCKELAAIAFVKYHASSTP

SEQ ID NO: 61 - DNA, 6259 bp, Homo sapiens
  CDS (125)..(1279)
gggcgggagcagcggcggcggcggcacaggctcggggccagccgggcgcgcatccccgggcgccctgcgcggtggagagcttggcgggctgcgggtgccgcaggacaggagtggacaaagcaagatggcagggatcttagcctggttctggaacgagaggttttggctcccgcacaatgtcacctgggcggacctgaagaacacggaggaggccaccttcccgcaggctgaggacctctatctcgcttttcccctggccttctgtatcttcatggtgcggctcatcttcgagagatttgtagccaaaccgtgcgccatagccctcaacattcaggccaatggaccacaaattgctccgcccaatgccattctggaaaaggtcttcactgcaattacaaagcatcctgatgaaaagagattggaaggcctctccaagcaactggactgggatgttcgaagcattcagcgctggtttcgacaaagacgcaatcaggagaagccaagcacgctgacgaggttctgtgagagcatgtggagattttcattttacctttatgtatttacctacggagtcagattcctgaaaaagaccccctggttgtggaatacgaggcattgctggtacaactacccctatcagccactcacaactgaccttcactactattacatcctggagctgtcgttttattggtctttgatgttttctcagttcactgatatcaaaagaaaggactttggcattatgttcctgcaccaccttgtatctattttcttgattaccttttcatatgtcaacaatatggcccgagtaggaacgctggtcctttgtcttcatgattcagctgatgctcttctggaggctgccaaaatggcaaattatgccaagtttcagaaaatgtgtgatctcctgtttgttatgtttgccgtggtttttatcaccacacgactgggtatatttcctctctgggtgttaaataccacattatttgaaagctgggagatcgttggaccttacccttcctggtgggtttttaacctactgctattgctagtacaagggttgaactgcttctggtcttacttgattgtgaaaatagcttgcaaagctgtttcaagaggcaaggtgtccaaggatgatcgaagtgatattgagtctagctcagatgaggaggactcagaacctccgggaaagaatccccacactgcgacaaccaccaatgggaccagtggtaccaacgggtatctcctgactggctcctgctccatggatgattaattactcaaaactacaagtcccaagcaaagtgaactatttgttcctggaagtatttaataagttgcaaatgcagttcctttcataatatctcagcaccagaaacaaaaattaagattatcaaagcattttgaatagtgcactgccatgtgtcctgtctgtgaatgaagaagaattaccattctctctttgtaggcatgctgtatgtaattgacacaagggaacagtatttgcatttgtactgtcttagaatattatttatttttttgtatttgtaaatctgtggacaaaagagggtttcctcactccttttactcactgggctcatgacagtgaaggagatgctccatctgcttctccccctttctcttgctgtagtccaatgtgctatgagcatcagcttactttgtcacttagagcaagcaaaacccagtgcaagagtctcgttcagctctaaataggtttgctttcttttagttacagtgcccattttgaaattgcctatacagtcttagtgaccatttaaaccggacgaactaggtgtttaattttcactcttcatgttcaattagcagttcaaattaaagaagatggttattggagaacttttttgaatggttttgtattaaattgctttgaaatagatttcatttcttgtgcacacagccaagatttcttcaatgggtgtgagctagttgagggttaaccttgtaggttgcagagtgtatttgtttgtttgtttgtttttctctgtgatgaggtcagtgctctgattttgaaggaggatattcactgaagctcatagttataaacaaggaaatcactgttaagaatgggaatttgtcctgtgttctgggaataacataaagagagcaactgatttcagccaggttttgccactaccctataattagtgcagtcttatgttataaaagaaagaagttaactatatttggggacaaaaaaatatttcaagagttgataaagattacctgtgcagtgcagagcactttaatgcaaccagctttcaagaaaaagccctatctagtacttgatgttgatgtttttattttgctgagcaaaataaagccaatgggagaaagactattttaccctttgcttttctccttaaacgtaatccagatgactttcctgttactaaacactgagcagcattacactacaatgcttctttggtttccaggaatttttttcaaatggggctgtttctggaaaaatgaaaaattctattggacaatggcaatatcaacaatgaggaaaattactgaagaataagtttccataagtctcctacatagcagtgttatttatgtacagataagaaaaccatatgtcagccaaagattttatctcttcttctaacttttagtaagaggaaaaagggattataaaacccttcataaatcaagaaggccatcacttagaacgaaccccaaacaaaaatgccataatataaatgtgtgaatcagggctgtgaagacaacagcagaaatgctaacaagcgtgcagaaacaccagagagtgcgtatcctgctcagaaccattcacatttaattcaattcttggaaaaaattaaagctttttgcccacaatttgcaatctgtgggttaatagttaaaagaatgttcccaaccaaaaaattcttaccgtaatattatatcttgccctacttatttacaaaataatatgtttctgttatggtccttagtaataattgaagaggcttagaaatacatctgcttgtttattgagaaaacgatgcaaataattctgcttttagagccttgttattttatttcacaaaacaggcatatgtctaggagtgtaatttgtggatggttgagtttgtaagaacaatcataaaaggacttgttagtctccagaacatctgctaaaatgcaagtatatgtataaggtaatagcatattacagctgaaaattttgagaaggtaaaagtttcttaattaaaatatgaacatatttagcttgctttagtgtctggggcaagtcctctcaatggctaaaattaactttagagatccatgtgttcaggtttagatcatatgacactcgagcacagaagaataatttcaaggaggtcatcttgtaaattaaaggtttagaagaattgcataaaacgtagtaaatggggtctgtcattagcaaaggcaaatctaagcaatcatttttccccccagaagttacttagaaggagaactgggaacacttggggtctctctaactgatggcattcacttcacacagtcgtctatgttatccagagatttttatttcattttacattttagggcacagttctttggggctaattaaaatggggtttgcaggctttttatggtgaagaataatatatctctgtctatagctttcccatggtagcctgataaggctgagagagaaaaatatgtgcagtatctcatcctccccctgtaccaggccatagctttgaagtgtattttgtaaattcaactataggttagtcagaatgctgtttttcgttaattaacttagcctgtgttgatatctcctccttcctggtcacattcaaaccttcccagagtacaaaggggtatgtagaaaggattccagaagaagtaatactttattctctaatgttaatagcttttctggatctcttagtagggggaaagtagaaaatcgagtagaatttggcctcaggtcaataaatgatataaaaacatgtgttctatttatgtatatatatgtatgtttctccaaaaagtgataaaaccaaaatatcactgactcatccctacccatattcttttcataaaacccactcaccaggtacaatagaaacttccctccttgtttgtcagcctcctgttcatgttccccacacacctgaaggtggtagaatcttttcagcctcttagccagtgagctaaatatggctaagcacaggtcataagagcacctaaggccagcatataagccaactacagttcacctttccaaatttggtcctatggatgttgagcatagggaagcaactctcagtattttggattattcaagtgtatgtggtaaaaatgcagatgattgctgctttaccccagggtttattagcatcctacttctgctgggctgcatcattatataatgccacaggcatctagtcaaggtaaagaagccagaaaggttaggcaagaagtgagataaaatcagatcacctttgatcaaaatggttggtgaacctccacatgtccagttctgttgccaaactttccattcagagtatttggtggagtttgaatttgagcaaactaaatgccttcatcttaggtagaaagggcctgaatcttccattttatattcaaacctcattgttatttggcctaagtaaaaagtcagatttcatttccatttacctgagttcgctttaaagagcttttcaaagagagctttatagacacccacaattgtccccaatctcttcatgatgttgcattaatagttgtttttgtccctttcttggaaatgttaatgccaaagttgcctgaacattgggcggttttcttaatttgaagtataaaaattataaagagtaattccaaaggtattaaaagattgtttaacagtatgtgtggtgatgtcattatctccagagaggcttcaagaaatcctttggaaataaaaagttaaatgtttacatttcatgtggtatttcaggtcttcaggttctgattagcttacttttttcctttgtctttggctgatttctgctttgtagataaataataatagccctgagatgtttctaacatttaaataagaaaaaaatcaaatcgaagtcagcctgctggaaaagtgatcacatggcagttgcagtaacttgtatggaaagagaaaatgcaatgagcccagttactgcacttgccactaccatgctgtccatggaaggaataatcagcagttcagttgtcacaagccgcccttgaagaaaacgcagcaaaatattttaaaatgaagatattgcagtccccagagccagtgaaggtttcttttggtaaaatgaaattgtgccattgtcaaagtaccccgtagtgatgagcactgactggttcactggccacattttagttcttcataataataggccacaaaagggctctgtggtttgcctccatgtgcactggcccctccccacccctagggggcactcagtagctgctgagaaggcctgtccacgaggctgttggaacccctccaataaatacttagaggtagtgtatctgatgcttgttttcgtggagaaaattgtattggagaacttaaaacatcacgaatatttttaataggatccgcagacacccaaaggagaagcttggtcttttccaggtatttccaacttgagttcaacccaaagcctttgaaaggaatgcattaccacatgaccacatgctgagaccccatggggtctaacacgggacctaagaaagtctctgcagccagatagtacatggtgtctccacaaaactaggcattctggagattgcccagaaagggatgtgaggggaccgttaagatctgtcttgcttatctcatgcactcacattccttcagcctcctggagttcctgataaaaggaagccagggtgttgacattttttagctattgatttcccaatagcttgtggatcagttgtacacccacacttccttctctgcctaattccgtttttctggaaaaagtagtatgcccatgtatgtgtgtttttcttaacacaggtccatgaaagtttggcttcctggtttgatgtctgttgcgtggcctggaaaccagggagcagcaactattgagatggtttctgtgttcagtgaaaaattctatttcattgagacaattttttctttatccacagtaattttttgacactgtcatcatgaaactacccttaggaaaataagattacctgc

SEQ ID NO: 62 - protein, 384 aa, Homo sapiens
MAGILAWFWNERFWLPHNVTWADLKNTEEATFPQAEDLYLAFPLAFCIFMVRLIFERFVAKPCAIALNIQANGPQIAPPNAILEKVFTAITKHPDEKRLEGLSKQLDWDVRSIQRWFRQRRNQEKPSTLTRFCESMWRFSFYLYVFTYGVRFLKKTPWLWNTRHCWYNYPYQPLTTDLHYYYILELSFYWSLMFSQFTDIKRKDFGIMFLHHLVSIFLITFSYVNNMARVGTLVLCLHDSADALLEAAKMANYAKFQKMCDLLFVMFAVVFITTRLGIFPLWVLNTTLFESWEIVGPYPSWWVFNLLLLLVQGLNCFWSYLIVKIACKAVSRGKVSKDDRSDIESSSDEEDSEPPGKNPHTATTTNGTSGTNGYLLTGSCSMDD

SEQ ID NO: 63 - DNA, 2133 bp, Homo sapiens
  CDS (179)..(1102)
agcggaggcggctgaagagttgctgtattctgggaatgggcagggtcactcgtccgaacagagtcctatcctacgcggcggaagagtgtgccctttgacttgcatcgtctacctacctctgccatcctctaccagccgcaactgcgagggctggagccaacttcaggactgattgatcatgacttctataaaggagcaggcagcaattagcaggctcttaagttttttacaggagtgggacaacgctggcaaagtcgcaaggagtcacatcctcgacaagttcattgaaaccaaccaaggcaagactgcccctgaactggagcaggagttttcccagggagccagtttgttcctggtacgcttgaccacctcgcttagaatcacctatatgactgactcatgtttagaaaagcttctcaggtccattggcatcttcttatcagctgtaagcagtaatcggtaccttatagaatttcttgaggttggaggtgtcctaaccctcttggaaatacttgggctagagaagatcaaggaggaggccaagaaggaatctgtcaaactacttcaggttattgcgaactctggcaggacatacaaggaactcatttgtgaaagctatggtgtacgatccatagcagaatttttggcaaagtctaagtcagaagagacccaggaggaagtgcaggttctgttggattctttggtccacggcaatcccaagtaccaaaatcaagtgtataaaggtctaatagctttgctgccctgcgagtccccaaaagcccagcagctgtccctgcagactctcaggactgcccagccaatcattgggaccacacaccccagcatcgtggactgcgtgctgaaggtgctgggcacgatgcacctggaagtccagtatgaagccatcgagttgatcaaagacctggtcggttacgatgtgcgccaggcgctgctcaagggcctcgtggcgctgctgataccgtcggtcaaggagatctccaaactgcaggccaagatcctcagtgacccctcggttctccagctcacccccagcctgccgatgtttttgcagcaggccgcggccgccaaggccatcgggtaagcgggcaggggttagtgggtagctgcagcaagcctggcttggcgctgccggcgggccccgggagcgctccgtgcgccgggtgggcgggggtgtgcgccgggtgagccccagggcgtcgccccagcccgaacccccggcccagggtcctggcgcgcaacgacatgagcatcgccgaggagctgctgtacctgcgcgtggtgcgtggcctaatggccgccatgggcaacacggaccacagcaacagccagcggctggccagcctcacgctggagatgttccccttggtggcggagcacgtgcgcaagtgcatgggggaggaactctaccagctcttcctggtaagtgcgcccttcctgccccgccgcaatgagcagatggcggctcggacagtgtgatgccccttcagacagtccccatcctggagcgcgccacatgcagagtggacctggccaccagctgcaggagggactgctctggcgtaggctcctccacccgccaccttcctgttccctttcctgccctttcggtcaggctgccgacccgcaccccacctgcaacatccctctgccaagcccaactccaagtccagactgccctggcaccccagccgggtcccccttgctcctgtcctcagagcaacgctgaggacttgtacatgaaaatagacagcattcaggcggacatcttggcggccaacacagtcaatgttaccaaagccctgtgcctccatggcagctcctacagcatgaacactctctatggctcgcgcgattcggctcagatggcctacctcacacacttcgaggaggatgtagaatcaaaggagtaacagcccctgtggcaaaccaggaaggccaaggctgcggggcagggaagcctggcaagaggaaggcgcctggggtcaagctcagagccactccacttggctccaggggggagacggggattaggcatcccagaggggcagaggaagagccgctggctgcgaagagtcaataaacagccttgatacctgaaaaaaaaaaaaaaaa

SEQ ID NO: 64 - protein, 307 aa, Homo sapiens
MTSIKEQAAISRLLSFLQEWDNAGKVARSHILDKFIETNQGKTAPELEQEFSQGASLFLVRLTTSLRITYMTDSCLEKLLRSIGIFLSAVSSNRYLIEFLEVGGVLTLLEILGLEKIKEEAKKESVKLLQVIANSGRTYKELICESYGVRSIAEFLAKSKSEETQEEVQVLLDSLVHGNPKYQNQVYKGLIALLPCESPKAQQLSLQTLRTAQPIIGTTHPSIVDCVLKVLGTMHLEVQYEAIELIKDLVGYDVRQALLKGLVALLIPSVKEISKLQAKILSDPSVLQLTPSLPMFLQQAAAAKAIG

SEQ ID NO: 65 - DNA, 802 bp, Homo sapiens
  CDS (253)..(696)
gctggccgtgggagaggcttaaaacaaacgccggaagcaactcccagccccataaagatctgtgaccggcagccccagacctgcctgccttcctgacttctgttccagagcaaaggtcattcagccgcttgaatcagccttttccccccacccggtccccaactttgtttacccgataaggaaggtcagcattcaaagtcaagaagcgccatttatcttcccgtgcgctctacaaatagttccgtgagaaagatggccgggaactcgatcctgctggctgctgtctctattctctcggcctgtcagcaaagttattttgctttgcaagttggaaaggcaagattaaaatacaaagttacgcccccagcagtcactgggtcaccagagtttgagagagtatttcgggcacaacaaaactgtgtggagttttatcctatattcataattacattgtggatggctgggtggtatttcaaccaagtttttgctacttgtctgggtctggtgtacatatatggccgtcacctatacttctggggatattcagaagctgctaaaaaacggatcaccggtttccgactgagtctggggattttggccttgttgaccctcctaggtgccctgggaattgcaaacagctttctggatgaatatctggacctcaatattgccaagaaactgaggcggcaattctaactttttctcttccctttaatgcttgcagaagctgttcccaccatgaaggtaatatggtatcatttgttaaataaaaataaagtctttattctgtttttcttgaaaa

SEQ ID NO: 66 - protein, 147 aa, Homo sapiens
MAGNSILLAAVSILSACQQSYFALQVGKARLKYKVTPPAVTGSPEFERVFRAQQNCVEFYPIFIITLWMAGWYFNQVFATCLGLVYIYGRHLYFWGYSEAAKKRITGFRLSLGILALLTLLGALGIANSFLDEYLDLNIAKKLRRQF

SEQ ID NO: 67 - DNA, 1386 bp, Homo sapiens
  CDS (170)..(1189)
gccagactggagagaagcaggcctgagcctccccaaaggcagctcctggggactcccaggaccacaggctgagacgagacgcagggtggctggaggaagtgagaggtgaactcagcctgggactggctgggcgagactctccacctgctccctgggaccatcgcccaccatggctgtggcccagcagctgcgggccgagagtgactttgaacagcttccggatgatgttgccatctcggccaacattgctgacatcgaggagaagagaggcttcaccagccactttgttttcgtcatcgaggtgaagacaaaaggaggatccaagtacctcatctaccgccgctaccgccagttccatgctttgcagagcaagctggaggagcgcttcgggccagacagcaagagcagtgccctggcctgtaccctgcccacactcccagccaaagtctacgtgggtgtgaaacaggagatcgccgagatgcggatacctgccctcaacgcctacatgaagagcctgctcagcctgccggtctgggtgctgatggatgaggacgtccggatcttcttttaccagtcgccctatgactcagagcaggtgccccaggcactccgccggctccgcccgcgcacccggaaagtcaagagcgtgtccccacagggcaacagcgttgaccgcatggcagctccgagagcagaggctctatttgacttcactggaaacagcaaactggagctgaatttcaaagctggagatgtgatcttcctcctcagtcggatcaacaaagactggctggagggcactgtccggggagccacgggcatcttccctctctccttcgtgaagatcctcaaagacttccctgaggaggacgaccccaccaactggctgcgttgctactactacgaagacaccatcagcaccatcaaggacatcgcggtggaggaagatctcagcagcactcccctattgaaagacctgctggagctcacaaggcgggagttccagagagaggacatagctctgaattaccgggacgctgagggggatctggttcggctgctgtcggatgaggacgtagcgctcatggtgcggcaggctcgtggcctcccctcccagaagcgcctcttcccctggaagctgcacatcacgcagaaggacaactacagggtctacaacacgatgccatgagctgacggtgtccctggagcagtgaggggacaccagcaaaaaccttcagctctcagaggagattgggaccaggaaaacctgggaggatgggcagacttcctgtctttgaggctaatggacccgtggggcttgtaatctgtctctttctactatttacatctgatttaaataaaccattccatctgaaaggggcaaaa

SEQ ID NO: 68 - protein, 339 aa, Homo sapiens
MAVAQQLRAESDFEQLPDDVAISANIADIEEKRGFTSHFVFVIEVKTKGGSKYLIYRRYRQFHALQSKLEERFGPDSKSSALACTLPTLPAKVYVGVKQEIAEMRIPALNAYMKSLLSLPVWVLMDEDVRIFFYQSPYDSEQVPQALRRLRPRTRKVKSVSPQGNSVDRMAAPRAEALFDFTGNSKLELNFKAGDVIFLLSRINKDWLEGTVRGATGIFPLSFVKILKDFPEEDDPTNWLRCYYYEDTISTIKDIAVEEDLSSTPLLKDLLELTRREFQREDIALNYRDAEGDLVRLLSDEDVALMVRQARGLPSQKRLFPWKLHITQKDNYRVYNTMP

SEQ ID NO: 69 - DNA, 1631 bp, Homo sapiens
  CDS (170)..(1216)
gccagactggagagaagcaggcctgagcctccccaaaggcagctcctggggactcccaggaccacaggctgagacgagacgcagggtggctggaggaagtgagaggtgaactcagcctgggactggctgggcgagactctccacctgctccctgggaccatcgcccaccatggctgtggcccagcagctgcgggccgagagtgactttgaacagcttccggatgatgttgccatctcggccaacattgctgacatcgaggagaagagaggcttcaccagccactttgttttcgtcatcgaggtgaagacaaaaggaggatccaagtacctcatctaccgccgctaccgccagttccatgctttgcagagcaagctggaggagcgcttcgggccagacagcaagagcagtgccctggcctgtaccctgcccacactcccagccaaagtctacgtgggtgtgaaacaggagatcgccgagatgcggatacctgccctcaacgcctacatgaagagcctgctcagcctgccggtctgggtgctgatggatgaggacgtccggatcttcttttaccagtcgccctatgactcagagcaggtgccccaggcactccgccggctccgcccgcgcacccggaaagtcaagagcgtgtccccacagggcaacagcgttgaccgcatggcagctccgagagcagaggctctatttgacttcactggaaacagcaaactggagctgaatttcaaagctggagatgtgatcttcctcctcagtcggatcaacaaagactggctggagggcactgtccggggagccacgggcatcttccctctctccttcgtgaagatcctcaaagacttccctgaggaggacgaccccaccaactggctgcgttgctactactacgaagacaccatcagcaccatcaagtctgtggcctgggagggaggggcctgtccagccttcctgccatccctacgaccaccgcccctcacatcaccttctcatgggtccctctcccactccaaagcccccagtggctcccagatgagccacaatgctgtaacaagccatcaacgtccagggtggcctggccagcctcattcccctttcccccaccccacaccccacttccagcctgatgcctccttactccagcctgtcacccccttagggacatcgcggtggaggaagatctcagcagcactcccctattgaaagacctgctggagctcacaaggcgggagttccagagagaggacatagctctgaattaccgggacgctgagggggatctggttcggctgctgtcggatgaggacgtagcgctcatggtgcggcaggctcgtggcctcccctcccagaagcgcctcttcccctggaagctgcacatcacgcagaaggacaactacagggtctacaacacgatgccatgagctgacggtgtccctggagcagtgaggggacaccagcaaaaaccttcagctctcagaggagattgggaccaggaaaacctgggaggatgggcagacttcctgtctttgaggctaatggacccgtggggcttgtaatctgtctctttctactatttacatctgatttaaataaaccattccatctgaaaggggcaaaa

SEQ ID NO: 70 - protein, 348 aa, Homo sapiens
MAVAQQLRAESDFEQLPDDVAISANIADIEEKRGFTSHFVFVIEVKTKGGSKYLIYRRYRQFHALQSKLEERFGPDSKSSALACTLPTLPAKVYVGVKQEIAEMRIPALNAYMKSLLSLPVWVLMDEDVRIFFYQSPYDSEQVPQALRRLRPRTRKVKSVSPQGNSVDRMAAPRAEALFDFTGNSKLELNFKAGDVIFLLSRINKDWLEGTVRGATGIFPLSFVKILKDFPEEDDPTNWLRCYYYEDTISTIKSVAWEGGACPAFLPSLRPPPLTSPSHGSLSHSKAPSGSQMSHNAVTSHQRPGWPGQPHSPFPHPTPHFQPDASLLQPVTPLGTSRWRKISAALPY

SEQ ID NO: 71 - DNA, 3198 bp, Homo sapiens
  CDS (97)..(2547)
ttgggaggagcagtctctccgctcgtctcccggagctttctccattgtctctgcctttacaacagagggagacgatggactgagctgatccgcaccatggagtctcgggtcttactgagaacattctgtttgatcttcggtctcggagcagtttgggggcttggtgtggacccttccctacagattgacgtcttaacagagttagaacttggggagtccacgaccggagtgcgtcaggtcccggggctgcataatgggacgaaagcctttctctttcaagatactcccagaagcataaaagcatccactgctacagctgaacagttttttcagaagctgagaaataaacatgaatttactattttggtgaccctaaaacagacccacttaaattcaggagttattctctcaattcaccacttggatcacaggtacctggaactggaaagtagtggccatcggaatgaagtcagactgcattaccgctcaggcagtcaccgccctcacacagaagtgtttccttacattttggctgatgacaagtggcacaagctctccttagccatcagtgcttcccatttgattttacacattgactgcaataaaatttatgaaagggtagtagaaaagccctccacagacttgcctctaggcacaacattttggctaggacagagaaataatgcgcatggatattttaagggtataatgcaagatgtccaattacttgtcatgccccagggatttattgctcagtgcccagatcttaatcgcacctgtccaacttgcaatgacttccatggacttgtgcagaaaatcatggagctacaggatattttagccaaaacatcagccaagctgtctcgagctgaacagcgaatgaatagattggatcagtgctattgtgaaaggacttgcaccatgaagggaaccacctaccgagaatttgagtcctggatagacggctgtaagaactgcacatgcctgaatggaaccatccagtgtgaaactctaatctgcccaaatcctgactgcccacttaagtcggctcttgcgtatgtggatggcaaatgctgtaaggaatgcaaatcgatatgccaatttcaaggacgaacctactttgaaggagaaagaaatacagtctattcctcttctggagtatgtgttctctatgagtgcaaggaccagaccatgaaacttgttgagagttcaggctgtccagctttggattgtccagagtctcatcagataaccttgtctcacagctgttgcaaagtttgtaaaggttatgacttttgttctgaaaggcataactgcatggagaattccatctgcagaaatctgaatgacagggctgtttgtagctgtcgagatggttttagggctcttcgagaggataatgcctactgtgaagacatcgatgagtgtgctgaagggcgccattactgtcgtgaaaatacaatgtgtgtcaacaccccgggttcttttatgtgcatctgcaaaactggatacatcagaattgatgattattcatgtacagaacatgatgagtgtatcacaaatcagcacaactgtgatgaaaatgctttatgcttcaacactgttggaggacacaactgtgtttgcaagccgggctatacagggaatggaacgacatgcaaagcattttgcaaagatggctgtaggaatggaggagcctgtattgccgctaatgtgtgtgcctgcccacaaggcttcactggacccagctgtgaaacggacattgatgaatgctctgatggttttgttcaatgtgacagtcgtgctaattgcattaacctgcctggatggtaccactgtgagtgcagagatggctaccatgacaatgggatgttttcaccaagtggagaatcgtgtgaagatattgatgagtgtgggaccgggaggcacagctgtgccaatgataccatttgcttcaatttggatggcggatatgattgtcgatgtcctcatggaaagaattgcacaggggactgcatccatgatggaaaagttaagcacaatggtcagatttgggtgttggaaaatgacaggtgctctgtgtgctcatgtcagaatggattcgttatgtgtcgacggatggtctgtgactgtgagaatcccacagttgatcttttttgctgccctgaatgtgacccaaggcttagtagtcagtgcctccatcaaaatggggaaactttgtataacagtggtgacacctgggtccagaattgtcaacagtgccgctgcttgcaaggggaagttgattgttggcccctgccttgcccagatgtggagtgtgaattcagcattctcccagagaatgagtgctgcccgcgctgtgtcacagacccttgccaggctgacaccatccgcaatgacatcaccaagacttgcctggacgaaatgaatgtggttcgcttcaccgggtcctcttggatcaaacatggcactgagtgtactctctgccagtgcaagaatggccacatctgttgctcagtggatccacagtgccttcaggaactgtgaagttaactgtctcatgggagatttctgttaaaagaatgttctttcattaaaagaccaaaaagaagttaaaacttaaattgggtgatttgtgggcagctaaatgcagctttgttaatagctgagtgaactttcaattatgaaatttgtggagcttgacaaaatcacaaaaggaaaattactggggcaaaattagacctcaagtctgcctctactgtgtctcacatcaccatgtagaagaatgggcgtacagtatataccgtgacatcctgaaccctggatagaaagcctgagcccattggatctgtgaaagcctctagcttcactggtgcagaaaattttcctctagatcagaatcttcagaatcagttaggttcctcactgcaagaaataaaatgtcaggcagtgaatgaattatattttcagaagtaaagcaaagaagctataacatgttatgtacagtacactctgaaaagaaatctgaaacaagttattgtaatgataaaaataatgcacaggcatggttacttaatattttctaacaggaaaagtcatccctatttccttgttttactgcacttaatattatttggttgaatttgttcagtataagctcgttcttgtgcaaaattaaataaatatttctcttacctt

SEQ ID NO: 72 - protein, 816 aa, Homo sapiens
MESRVLLRTFCLIFGLGAVWGLGVDPSLQIDVLTELELGESTTGVRQVPGLHNGTKAFLFQDTPRSIKASTATAEQFFQKLRNKHEFTILVTLKQTHLNSGVILSIHHLDHRYLELESSGHRNEVRLHYRSGSHRPHTEVFPYILADDKWHKLSLAISASHLILHIDCNKIYERVVEKPSTDLPLGTTFWLGQRNNAHGYFKGIMQDVQLLVMPQGFIAQCPDLNRTCPTCNDFHGLVQKIMELQDILAKTSAKLSRAEQRMNRLDQCYCERTCTMKGTTYREFESWIDGCKNCTCLNGTIQCETLICPNPDCPLKSALAYVDGKCCKECKSICQFQGRTYFEGERNTVYSSSGVCVLYECKDQTMKLVESSGCPALDCPESHQITLSHSCCKVCKGYDFCSERHNCMENSICRNLNDRAVCSCRDGFRALREDNAYCEDIDECAEGRHYCRENTMCVNTPGSFMCICKTGYIRIDDYSCTEHDECITNQHNCDENALCFNTVGGHNCVCKPGYTGNGTTCKAFCKDGCRNGGACIAANVCACPQGFTGPSCETDIDECSDGFVQCDSRANCINLPGWYHCECRDGYHDNGMFSPSGESCEDIDECGTGRHSCANDTICFNLDGGYDCRCPHGKNCTGDCIHDGKVKHNGQIWVLENDRCSVCSCQNGFVMCRRMVCDCENPTVDLFCCPECDPRLSSQCLHQNGETLYNSGDTWVQNCQQCRCLQGEVDCWPLPCPDVECEFSILPENECCPRCVTDPCQADTIRNDITKTCLDEMNVVRFTGSSWIKHGTECTLCQCKNGHICCSVDPQCLQEL

SEQ ID NO: 73 - DNA, 1323 bp, Homo sapiens
  CDS (36)..(902)
agagctggctgcgccgagccccctgcgcgctgcacatggggcgcctgacggaagcggcggcagcgggcagcggctctcgggctgcaggctgggcagggtcccctcccacgctcctgccgctgtctcccacgtcccccaggtgcgcggccaccatggcgtccagcgacgaggacggcaccaacggcggcgcctcggaggccggcgaggaccgggaggctcccggcgagcggaggcgcctgggggtcttggccaccgcctggctcaccttctacgacatcgccatgaccgcggggtggttggttctagctattgccatggtacgtttttatatggaaaaaggaacacacagaggtttatataaaagtattcagaagacacttaaatttttccagacatttgccttgcttgagatagttcactgtttaattggaattgtacctacttctgtgattgtgactggggtccaagtgagttcaagaatctttatggtgtggctcattactcacagtataaaaccaatccagaatgaagagagtgtggtgctttttctggtcgcgtggactgtgacagagatcactcgctattccttctacacattcagccttcttgaccacttgccatacttcattaaatgggccagatataatttttttatcatcttatatcctgttggagttgctggtgaacttcttacaatatacgctgccttgccgcatgtgaagaaaacaggaatgttttcaataagacttcctaacaaatacaatgtctcttttgactactattattttcttcttataaccatggcatcatatatacctttgtttccacaactctattttcatatgttacgtcaaagaagaaaggtgcttcatggagaggtgattgtagaaaaggatgattaaatgatctctgcaaacaaggtgctttttccagaataaccaagattacctgagtccaagttttaataacaagaataaacaactttgtgaaatatcatggattgtatggtttcttaaaatataacttgagacacgtggtatttgccagtatttgtgttcctcttgtgccagatctattttttacaagaactgtgcaaatatcagtaacttttgggtaggtattgattattaggaaaataattaggtgtattatctgggggaaaaaaaaacttttgctaagttttttttgaaacatgctcaaagctttttaaatcaatatttagaaattagtttaacgatttactattatacctgctagtgatatttatgtgatatttataaatgaaaataaatgcaaaattataacaaaaaaaaaaaaaaaaaa

SEQ ID NO: 74 - protein, 288 aa, Homo sapiens
MGRLTEAAAAGSGSRAAGWAGSPPTLLPLSPTSPRCAATMASSDEDGTNGGASEAGEDREAPGERRRLGVLATAWLTFYDIAMTAGWLVLAIAMVRFYMEKGTHRGLYKSIQKTLKFFQTFALLEIVHCLIGIVPTSVIVTGVQVSSRIFMVWLITHSIKPIQNEESVVLFLVAWTVTEITRYSFYTFSLLDHLPYFIKWARYNFFIILYPVGVAGELLTIYAALPHVKKTGMFSIRLPNKYNVSFDYYYFLLITMASYIPLFPQLYFHMLRQRRKVLHGEVIVEKDD

SEQ ID NO: 75 - DNA, 728 bp, Homo sapiens
  CDS (46)..(654)
gcggcctcagatgaatgcggctgttaagacctgcaataatccagaatggctactctgatctatgttgataaggaaaatggagaaccaggcacccgtgtggttgctaaggatgggctgaagctggggtctggaccttcaatcaaagccttagatgggagatctcaagtttcaacaccacgttttggcaaaacgttcgatgccccaccagccttacctaaagctactagaaaggctttgggaactgtcaacagagctacagaaaagtctgtaaagaccaagggacccctcaaacaaaaacagccaagcttttctgccaaaaagatgactgagaagactgttaaagcaaaaagctctgttcctgcctcagatgatgcctatccagaaatagaaaaattctttcccttcaatcctctagactttgagagttttgacctgcctgaagagcaccagattgcgcacctccccttgagtggagtgcctctcatgatccttgacgaggagagagagcttgaaaagctgtttcagctgggccccccttcacctgtgaagatgccctctccaccatgggaatccaatctgttgcagtctccttcaagcattctgtcgaccctggatgttgaattgccacctgtttgctgtgacatagatatttaaatttcttagtgcttcagagtttgtgtgtatttgtattaataaagcattcttcaacagaaaaaaaaaaaaaaaaa

SEQ ID NO: 76 - protein, 202 aa, Homo sapiens
MATLIYVDKENGEPGTRVVAKDGLKLGSGPSIKALDGRSQVSTPRFGKTFDAPPALPKATRKALGTVNRATEKSVKTKGPLKQKQPSFSAKKMTEKTVKAKSSVPASDDAYPEIEKFFPFNPLDFESFDLPEEHQIAHLPLSGVPLMILDEERELEKLFQLGPPSPVKMPSPPWESNLLQSPSSILSTLDVELPPVCCDIDI

SEQ ID NO: 77 - DNA, 609 bp, Homo sapiens
  CDS (1)..(609)
atggctactctgatctatgttgataaggaaaacgaagaaccaggcatccttgtggctacaaaggatgggctgaagctggggtctggaccttcaatcaaagccttagatgggagatctcaagtttcaatatcatgttttggcaaaacattcgatgctcccacatccttacctaaagctaccagaaaggctttgggaactgtcaacagagctacagaaaagtcagtaaagaccaatggacccctcaaacaaaaacagccaagcttttctgccaaaaagatgactgagaagactgttaaagcaaaaaactctgttcctgcctcagatgatggctatccagaaatagaaaaattatttcccttcaatcctctaggcttcgagagttttgacctgcctgaagagcaccagattgcacatctccccttgagtgaagtgcctctcatgatacttgatgaggagagagagcttgaaaagctgtttcagctgggccccccttcacctttgaagatgccctctccaccatggaaatccaatctgttgcagtctcctttaagcattctgttgaccctggatgttgaattgccacctgtttgctgtgacatagatatttaa

SEQ ID NO: 78 - protein, 202 aa, Homo sapiens
MATLIYVDKENEEPGILVATKDGLKLGSGPSIKALDGRSQVSISCFGKTFDAPTSLPKATRKALGTVNRATEKSVKTNGPLKQKQPSFSAKKMTEKTVKAKNSVPASDDGYPEIEKLFPFNPLGFESFDLPEEHQIAHLPLSEVPLMILDEERELEKLFQLGPPSPLKMPSPPWKSNLLQSPLSILLTLDVELPPVCCDIDI

SEQ ID NO: 79 - DNA, 4965 bp, Homo sapiens
  CDS (256)..(4119)
cgctctcggctagctgcagcggcggcggcgcggaggggaaggcatccaggatgcggtgcggggcggcccggtgcccccccgccccgtcacggcagccgcggcggccgaggggaccgggccagggccgggggcggcggcccgagccgcggtagcggcggcggcgggaggggcggcctgagggcggacgggcgggcgcccgggttgcgggggctcggtgccgctccgcactgcccggccggtctcggccccggcgccatgagtggcggcggcggcggagggggctcggcgcccagtcgcttcgccgactactttgtcatctgcggactggacacggagaccgggctggagccggacgagctgtcggcattatgccagtacatacaggcttctaaagccagggatggtgccagccctttcatttcaagtacgactgaaggagaaaattttgagcagacaccattgagaagaacattcaaatctaaggtccttgcacgatatcctgagaacgtagaatggaatccctttgaccaagatgcagtaggaatgctatgtatgccgaaagggctggcattcaagacccaggctgatcccagggagccccaattccatgcctttattatcacaagggaggatggctctcggacatttgggtttgccctcacattttatgaagaggtgactagcaagcagatctgcagtgcaatgcagaccctctaccacatgcacaatgctgagtatgatgtcctacatgctccccctgctgatgacagagaccagagcagcatggaggatggtgaagacactcctgtgaccaaactgcagcgcttcaactcctatgacattagccgggacactctctacgtctctaagtgcatctgcctcatcacacccatgtctttcatgaaggcatgtcggagcgtgctggagcaactccaccaggcagtcacttcacctcagccccctccactgccccttgagagctacatatacaacgtactctacgaggtgccgctcccacctcctggccggtccttgaagttttctggggtctatgggccaataatctgccagagaccaagtaccaatgagcttcccctatttgactttcctgtcaaagaggtttttgaactgctcggggtggagaatgtgtttcagctttttacttgtgcccttctggagtttcaaatcctgctctactcacagcattaccagagactgatgactgtggcggagacgattacagctctcatgtttcctttccagtggcagcatgtctatgtccctattctcccagcttctctcctgcatttcttagatgctcctgttccatacctgatgggtttgcattccaatggcctggatgaccggtcaaagctggagctgcctcaagaggctaacctctgctttgtggacattgacaaccacttcattgagttgccagaggacttgccacagttccccaacaaattggagtttgtccaggaagtctctgagattctcatggcatttggaattccccctgaagggaatcttcattgcagtgagagtgcctccaagctgaagaggctgcgggcctctgagcttgtctcggacaagaggaatgggaacattgctggctcccctttgcattcctacgagcttcttaaggagaatgaaactattgcccggctgcaagccttggtcaagagaactggggtgagcctggaaaagttggaagtgcgtgaagaccccagcagcaataaggatctcaaagttcagtgtgatgaagaagaactcaggatttaccagctaaacattcagatccgggaagtttttgcaaatcgtttcactcagatgtttgcagattatgaggtgtttgtcatccaacccagccaggataaggaatcctggtttaccaacagggagcaaatgcaaaactttgataaagcatcttttctgtcagatcagcctgagccctacctgcccttcctctcaagattcctggagacccagatgtttgcatctttcattgacaacaaaataatgtgtcatgatgatgatgataaagaccctgtactccgggtatttgattcccgagttgacaagatcaggctgttgaatgttcggacacctactctccgtacatccatgtaccagaagtgtaccactgtggatgaagcagagaaagcaattgagctgcgtctggcaaaaattgaccatactgcaattcacccacatttacttgacatgaagattggacaagggaaatatgagccgggcttcttccctaagctgcagtctgatgtactttccactgggccagccagcaacaagtggacgaaaaggaatgcccctgcccagtggaggcggaaagatcggcagaagcagcacacagaacacctgcgtttagataatgaccagagggagaagtacatccaggaagccaggactatgggcagcactatccgccagcccaaactgtccaacctctctccatcagtgattgcccagaccaattggaagtttgtagagggcctgctgaaggaatgccgcaataagaccaagaggatgctggtggaaaagatgggccgagaagctgtggagctagggcatggggaggtgaacatcacaggggtggaagagaacaccctgattgccagcctttgtgatctcctggaaaggatctggagtcatggactacaagtgaaacaggggaaatcagccttatggtcccacctgttacattatcaggacaaccggcagagaaaactcacatcaggaagcctcagtacctcaggaatacttcttgattcagaacgtaggaagtctgatgccagctcactcatgcctcccctgaggatctccctgattcaggatatgaggcacatccagaacatcggggaaatcaagactgatgtgggaaaggccagagcatgggtgcgactgtccatggaaaaaaagttactttccagacacctgaagcagctcctctcagaccatgagctcaccaaaaagttatataagcgctatgccttcctgcgctgtgatgacgagaaggagcagttcctctatcacctcctgtctttcaatgccgtcgattacttttgcttcaccaatgtcttcacaactatcctgatcccgtaccacattctgatcgtaccaagcaagaagctggggggctccatgttcactgccaacccatggatctgtatatcaggagaattgggtgagacacagatcatgcagattcccaggaatgtgctagagatgaccttcgagtgccagaacttggggaagcttactactgtccagattggccatgataactctgggctgtatgccaaatggctggtggagtatgtgatggtcaggaatgagatcacaggacatacctacaagttcccgtgtggccggtggttagggaagggcatggatgatggaagcctggagcggatcctagttggggagctgctcacatcccagcctgaggtggatgagaggccatgccggaccccgccgctgcagcagtcccccagtgtcatccggaggcttgttaccatctcacccaacaacaagcccaagctgaacactgggcagatccaggagtccatcggggaggcagtcaatggcattgtgaagcacttccataagcctgagaaagagcgaggcagtctgacgctgttgctctgtggagagtgtggccttgtctcggccttggaacaggctttccagcatggatttaaatcgccccggctcttcaaaaatgtcttcatttgggatttcctggaaaaagcacaaacctattatgagacattagagaagaatgaagtagtccctgaggaaaactggcatacaagagcccggaacttctgccgatttgtcactgcaatcaacaatactccccggaacatcggcaaggatggcaagtttcagatgctggtgtgcttgggagccagagatcacctcctacaccactggattgccctgctggctgactgccccatcactgcacacatgtatgaggatgtggcactgatcaaagaccatacacttgtcaattccttgattcgtgtgctgcagacattgcaggagttcaacatcacgctggagacgtcccttgtcaagggcatcgacatctgacctcccagcaccagccagcagcaggactgagaaagactcaccctgcagctctgaccttttttcccaaagggacttaagcgattgtgcaggagtaggagacaaaatgtacactcactgtaaaaagaaaactagaggatttttggaataaataatctattttagagtttatttgctgatttgctttttacacactttcatgtgaaagagtgatagggagagggagcgaggctggtgccgcttattttgaagctggtgccctccctcgccgtggccacatgctggaagcctgaggcctccctggactgagcctgtggcactgcgtgcgggacagttatgtttccttgccccgtcgcattaatgaggcccttccacatcatttttaaactaatgtttttctatattaacattattatggatatttggctttcataggccacacacaggtgtgctgcgcgggaagccccatgctccaatcaaagggatttttagtagtgcctctaagcaagcaccgatgagtcagtcccacgtattttcttttttgtcagtattgtttgggaaggagacatgccgggatgtgtcatcgtgccaaataccacatttcctgttggcacagtttcacagaagtaaacataagcatgttttaacaggtttttcttttcttttttcttttttaaaatgttttatttatttaacccgccattgtgtgtttttaagtattttctttttttaaggaaaggaaaagcttgtcacaatctaactggctatgttattattattaaatttatgttttgcaacttagaaaccagctacagtatggcccacttaataaaacacctgaaacaaaaa

SEQ ID NO: 80 - protein, 1287 aa, Homo sapiens
MSGGGGGGGSAPSRFADYFVICGLDTETGLEPDELSALCQYIQASKARDGASPFISSTTEGENFEQTPLRRTFKSKVLARYPENVEWNPFDQDAVGMLCMPKGLAFKTQADPREPQFHAFIITREDGSRTFGFALTFYEEVTSKQICSAMQTLYHMHNAEYDVLHAPPADDRDQSSMEDGEDTPVTKLQRFNSYDISRDTLYVSKCICLITPMSFMKACRSVLEQLHQAVTSPQPPPLPLESYIYNVLYEVPLPPPGRSLKFSGVYGPIICQRPSTNELPLFDFPVKEVFELLGVENVFQLFTCALLEFQILLYSQHYQRLMTVAETITALMFPFQWQHVYVPILPASLLHFLDAPVPYLMGLHSNGLDDRSKLELPQEANLCFVDIDNHFIELPEDLPQFPNKLEFVQEVSEILMAFGIPPEGNLHCSESASKLKRLRASELVSDKRNGNIAGSPLHSYELLKENETIARLQALVKRTGVSLEKLEVREDPSSNKDLKVQCDEEELRIYQLNIQIREVFANRFTQMFADYEVFVIQPSQDKESWFTNREQMQNFDKASFLSDQPEPYLPFLSRFLETQMFASFIDNKIMCHDDDDKDPVLRVFDSRVDKIRLLNVRTPTLRTSMYQKCTTVDEAEKAIELRLAKIDHTAIHPHLLDMKIGQGKYEPGFFPKLQSDVLSTGPASNKWTKRNAPAQWRRKDRQKQHTEHLRLDNDQREKYIQEARTMGSTIRQPKLSNLSPSVIAQTNWKFVEGLLKECRNKTKRMLVEKMGREAVELGHGEVNITGVEENTLIASLCDLLERIWSHGLQVKQGKSALWSHLLHYQDNRQRKLTSGSLSTSGILLDSERRKSDASSLMPPLRISLIQDMRHIQNIGEIKTDVGKARAWVRLSMEKKLLSRHLKQLLSDHELTKKLYKRYAFLRCDDEKEQFLYHLLSFNAVDYFCFTNVFTTILIPYHILIVPSKKLGGSMFTANPWICISGELGETQIMQIPRNVLEMTFECQNLGKLTTVQIGHDNSGLYAKWLVEYVMVRNEITGHTYKFPCGRWLGKGMDDGSLERILVGELLTSQPEVDERPCRTPPLQQSPSVIRRLVTISPNNKPKLNTGQIQESIGEAVNGIVKHFHKPEKERGSLTLLLCGECGLVSALEQAFQHGFKSPRLFKNVFIWDFLEKAQTYYETLEKNEVVPEENWHTRARNFCRFVTAINNTPRNIGKDGKFQMLVCLGARDHLLHHWIALLADCPITAHMYEDVALIKDHTLVNSLIRVLQTLQEFNITLETSLVKGIDI

SEQ ID NO: 81 - DNA, 2438 bp, Homo sapiens
  CDS (432)..(1652)
caccaagcgcagccgccgctgccgcactttccacttgtattgatcacctctcagccccgcgcagccggctcgcccgagcggaccgcggccagcgcgccagcccttggcagccccggagcagtcgggctccgggaggaaactccttgggagcgccctgtccggggtgccctctgcgctctgcagtgtctttctttctgcctgggaggaggaggaggaggaggaagaggaggaggaggaggaggaggaggaggaagaggaggaggaggaggaggacgtctggtcccggctgggaggtggagcagcggcagcagcagcagccgccgccgccgccgccgctgccgccgccgccggaaagggagaggcaggagagcccgagacttggaaaccccaaagtgtccgcgaccctgcacggcaggctcccttccagcttcatgggcaaagtgtggaaacagcagatgtaccctcagtacgccacctactattacccccagtatctgcaagccaagcagtctctggtcccagcccaccccatggcccctcccagtcccagcaccaccagcagtaataacaacagtagcagcagtagcaactcaggatgggatcagctcagcaaaacgaacctctatatccgaggactgcctccccacaccaccgaccaggacctggtgaagctctgtcaaccatatgggaaaatagtctccacaaaggcaattttggataagacaacgaacaaatgcaaaggttatggttttgtcgactttgacagccctgcagcagctcaaaaagctgtgtctgccctgaaggccagtggggttcaagctcaaatggcaaagcaacaggaacaagatcctaccaacctctacatttctaatttgccactctccatggatgagcaagaactagaaaatatgctcaaaccatttggacaagttatttctacaaggatactacgtgattccagtggtacaagtcgtggtgttggctttgctaggatggaatcaacagaaaaatgtgaagctgttattggtcattttaatggaaaatttattaagacaccaccaggagtttctgcccccacagaacctttattgtgtaagtttgctgatggaggacagaaaaagagacagaacccaaacaaatacatccctaatggaagaccatggcatagagaaggagaggtgagacttgctggaatgacacttacttacgacccaactacagctgctatacagaacggattttatccttcaccatacagtattgctacaaaccgaatgatcactcaaacttctattacaccctatattgcatctcctgtatctgcctaccaggtgcaaagtccttcgtggatgcaacctcaaccatatattctacagcaccctggtgccgtgttaactccctcaatggagcacaccatgtcactacagcccgcatcaatgatcagccctctggcccagcagatgagtcatctgtcactaggcagcaccggaacatacatgcctgcaacgtcagctatgcaaggagcctacttgccacagtatgcacatatgcagacgacagcggttcctgttgaggaggcaagtggtcaacagcaggtggctgtcgagacgtctaatgaccattctccatatacctttcaacctaataagtaactgtgagatgtacagaaaggtgttcttacatgaagaagggtgtgaaggctgaacaatcatggatttttctgatcaattgtgctttaggaaattattgacagttttgcacaggttcttgaaaacgttatttataatgaaatcaactaaaactatttttgctataagttctataaggtgcataaaacccttaaattcatctagtagctgttcccccgaacaggtttattttagtaaaaaaaaaaaaacaaaaaacaaaaacaaaagatttttatcaaatgttatgatgcaaaaaaagaaaaagaaaaaaaaaaagaaaagaaaacttcaattttctgggtatgcacaaagaccatgaagacttatccaagtgcatgaccggatttttgtggttttgttcattttgtgtttaatttgtgttttttttttccagctgtatgaaatgggctttctgaagtttaaatagtccgacttcacccatggtgttctgtgcttgcagtgcgagtgttgctgtaattcagtgttgccgtcagtgtctcttttcttagctttctgtctttctttcaacgtagtgtgaagtgtcttatccttttctatgaattccaatttgccttaactcttttgatgctgtagctgtttcagtaaaagttagttcaaactaatgatgtagaatgctttgaccaaatgagctggtctattatgccttgtaaaacagcagcatagggcttttaaaaggtagtcaataaaagttgctgaaattttggcttttttaaaaaaaaaaaaaaaaaa

SEQ ID NO: 82 - protein, 406 aa, Homo sapiens
MGKVWKQQMYPQYATYYYPQYLQAKQSLVPAHPMAPPSPSTTSSNNNSSSSSNSGWDQLSKTNLYIRGLPPHTTDQDLVKLCQPYGKIVSTKAILDKTTNKCKGYGFVDFDSPAAAQKAVSALKASGVQAQMAKQQEQDPTNLYISNLPLSMDEQELENMLKPFGQVISTRILRDSSGTSRGVGFARMESTEKCEAVIGHFNGKFIKTPPGVSAPTEPLLCKFADGGQKKRQNPNKYIPNGRPWHREGEVRLAGMTLTYDPTTAAIQNGFYPSPYSIATNRMITQTSITPYIASPVSAYQVQSPSWMQPQPYILQHPGAVLTPSMEHTMSLQPASMISPLAQQMSHLSLGSTGTYMPATSAMQGAYLPQYAHMQTTAVPVEEASGQQQVAVETSNDHSPYTFQPNK

SEQ ID NO: 83 - DNA, 2596 bp, Homo sapiens
  CDS (641)..(1810)
caccaagcgcagccgccgctgccgcactttccacttgtattgatcacctctcagccccgcgcagccggctcgcccgagcggaccgcggccagcgcgccagcccttggcagccccggagcagtcgggctccgggaggaaactccttgggagcgccctgtccggggtgccctctgcgctctgcagtgtctttctttctgcctgggaggaggaggaggaggaggaagaggaggaggaggaggaggaggaggaggaagaggaggaggaggaggaggacgtctggtcccggctgggaggtggagcagcggcagcagcagcagccgccgccgccgccgccgctgccgccgccgccggaaagggagaggcaggagagcccgagacttggaaaccccaaagtgtccgcgaccctgcacggcaggctcccttccagcttcatgggcaaagtgtggaaacagcagatgtaccctcagtacgccacctactattacccccagtatctgcaagccaagtttggaaggcattcgggaataccaagtgaaaaggaagagtgaagaacagaaaaatgttagtgggatggcaaacactgtgaacattgctgtttctagtgggccagaaaaatcagtctctggtcccagcccaccccatggcccctcccagtcccagcaccaccagcagtaataacaacagtagcagcagtagcaactcaggatgggatcagctcagcaaaacgaacctctatatccgaggactgcctccccacaccaccgaccaggacctggtgaagctctgtcaaccatatgggaaaatagtctccacaaaggcaattttggataagacaacgaacaaatgcaaaggttatggttttgtcgactttgacagccctgcagcagctcaaaaagctgtgtctgccctgaaggccagtggggttcaagctcaaatggcaaagcaacaggaacaagatcctaccaacctctacatttctaatttgccactctccatggatgagcaagaactagaaaatatgctcaaaccatttggacaagttatttctacaaggatactacgtgattccagtggtacaagtcgtggtgttggctttgctaggatggaatcaacagaaaaatgtgaagctgttattggtcattttaatggaaaatttattaagacaccaccaggagtttctgcccccacagaacctttattgtgtaagtttgctgatggaggacagaaaaagagacagaacccaaacaaatacatccctaatggaagaccatggcatagagaaggagaggtgagacttgctggaatgacacttacttacgacccaactacagctgctatacagaacggattttatccttcaccatacagtattgctacaaaccgaatgatcactcaaacttctattacaccctatattgcatctcctgtatctgcctaccaggtggcaaaggaaaccagagaaaacaagtatcggggctctgctatcaaggtgcaaagtccttcgtggatgcaacctcaaccatatattctacagcaccctggtgccgtgttaactccctcaatggagcacaccatgtcactacagcccgcatcaatgatcagccctctggcccagcagatgagtcatctgtcactaggcagcaccggaacatacatgcctgcaacgtcagctatgcaaggagcctacttgccacagtatgcacatatgcagacgacagcggttcctgttgaggaggcaagtggtcaacagcaggtggctgtcgagacgtctaatgaccattctccatatacctttcaacctaataagtaactgtgagatgtacagaaaggtgttcttacatgaagaagggtgtgaaggctgaacaatcatggatttttctgatcaattgtgctttaggaaattattgacagttttgcacaggttcttgaaaacgttatttataatgaaatcaactaaaactatttttgctataagttctataaggtgcataaaacccttaaattcatctagtagctgttcccccgaacaggtttattttagtaaaaaaaaaaaaacaaaaaacaaaaacaaaagatttttatcaaatgttatgatgcaaaaaaagaaaaagaaaaaaaaaaagaaaagaaaacttcaattttctgggtatgcacaaagaccatgaagacttatccaagtgcatgaccggatttttgtggttttgttcattttgtgtttaatttgtgttttttttttccagctgtatgaaatgggctttctgaagtttaaatagtccgacttcacccatggtgttctgtgcttgcagtgcgagtgttgctgtaattcagtgttgccgtcagtgtctcttttcttagctttctgtctttctttcaacgtagtgtgaagtgtcttatccttttctatgaattccaatttgccttaactcttttgatgctgtagctgtttcagtaaaagttagttcaaactaatgatgtagaatgctttgaccaaatgagctggtctattatgccttgtaaaacagcagcatagggcttttaaaaggtagtcaataaaagttgctgaaattttggcttttttaaaaaaaaaaaaaaaaaa

SEQ ID NO: 84 - protein, 389 aa, Homo sapiens
MAPPSPSTTSSNNNSSSSSNSGWDQLSKTNLYIRGLPPHTTDQDLVKLCQPYGKIVSTKAILDKTTNKCKGYGFVDFDSPAAAQKAVSALKASGVQAQMAKQQEQDPTNLYISNLPLSMDEQELENMLKPFGQVISTRILRDSSGTSRGVGFARMESTEKCEAVIGHFNGKFIKTPPGVSAPTEPLLCKFADGGQKKRQNPNKYIPNGRPWHREGEVRLAGMTLTYDPTTAAIQNGFYPSPYSIATNRMITQTSITPYIASPVSAYQVAKETRENKYRGSAIKVQSPSWMQPQPYILQHPGAVLTPSMEHTMSLQPASMISPLAQQMSHLSLGSTGTYMPATSAMQGAYLPQYAHMQTTAVPVEEASGQQQVAVETSNDHSPYTFQPNK

SEQ ID NO: 85 - DNA, 2429 bp, Homo sapiens
  CDS (432)..(1643)
caccaagcgcagccgccgctgccgcactttccacttgtattgatcacctctcagccccgcgcagccggctcgcccgagcggaccgcggccagcgcgccagcccttggcagccccggagcagtcgggctccgggaggaaactccttgggagcgccctgtccggggtgccctctgcgctctgcagtgtctttctttctgcctgggaggaggaggaggaggaggaagaggaggaggaggaggaggaggaggaggaagaggaggaggaggaggaggacgtctggtcccggctgggaggtggagcagcggcagcagcagcagccgccgccgccgccgccgctgccgccgccgccggaaagggagaggcaggagagcccgagacttggaaaccccaaagtgtccgcgaccctgcacggcaggctcccttccagcttcatgggcaaagtgtggaaacagcagatgtaccctcagtacgccacctactattacccccagtatctgcaagccaagcagtctctggtcccagcccaccccatggcccctcccagtcccagcaccaccagcagtaataacaacagtagcagcagtagcaactcaggatgggatcagctcagcaaaacgaacctctatatccgaggactgcctccccacaccaccgaccaggacctggtgaagctctgtcaaccatatgggaaaatagtctccacaaaggcaattttggataagacaacgaacaaatgcaaaggttatggttttgtcgactttgacagccctgcagcagctcaaaaagctgtgtctgccctgaaggccagtggggttcaagctcaaatggcaaagcaacaggaacaagatcctaccaacctctacatttctaatttgccactctccatggatgagcaagaactagaaaatatgctcaaaccatttggacaagttatttctacaaggatactacgtgattccagtggtacaagtcgtggtgttggctttgctaggatggaatcaacagaaaaatgtgaagctgttattggtcattttaatggaaaatttattaagacaccaccaggagtttctgcccccacagaacctttattgtgtaagtttgctgatggaggacagaaaaagagacagaacccaaacaaatacatccctaatggaagaccatggcatagagaaggagaggctggaatgacacttacttacgacccaactacagctgctatacagaacggattttatccttcaccatacagtattgctacaaaccgaatgatcactcaaacttctattacaccctatattgcatctcctgtatctgcctaccaggtgcaaagtccttcgtggatgcaacctcaaccatatattctacagcaccctggtgccgtgttaactccctcaatggagcacaccatgtcactacagcccgcatcaatgatcagccctctggcccagcagatgagtcatctgtcactaggcagcaccggaacatacatgcctgcaacgtcagctatgcaaggagcctacttgccacagtatgcacatatgcagacgacagcggttcctgttgaggaggcaagtggtcaacagcaggtggctgtcgagacgtctaatgaccattctccatatacctttcaacctaataagtaactgtgagatgtacagaaaggtgttcttacatgaagaagggtgtgaaggctgaacaatcatggatttttctgatcaattgtgctttaggaaattattgacagttttgcacaggttcttgaaaacgttatttataatgaaatcaactaaaactatttttgctataagttctataaggtgcataaaacccttaaattcatctagtagctgttcccccgaacaggtttattttagtaaaaaaaaaaaaacaaaaaacaaaaacaaaagatttttatcaaatgttatgatgcaaaaaaagaaaaagaaaaaaaaaaagaaaagaaaacttcaattttctgggtatgcacaaagaccatgaagacttatccaagtgcatgaccggatttttgtggttttgttcattttgtgtttaatttgtgttttttttttccagctgtatgaaatgggctttctgaagtttaaatagtccgacttcacccatggtgttctgtgcttgcagtgcgagtgttgctgtaattcagtgttgccgtcagtgtctcttttcttagctttctgtctttctttcaacgtagtgtgaagtgtcttatccttttctatgaattccaatttgccttaactcttttgatgctgtagctgtttcagtaaaagttagttcaaactaatgatgtagaatgctttgaccaaatgagctggtctattatgccttgtaaaacagcagcatagggcttttaaaaggtagtcaataaaagttgctgaaattttggcttttttaaaaaaaaaaaaaaaaaa

SEQ ID NO: 86 - protein, 403 aa, Homo sapiens
MGKVWKQQMYPQYATYYYPQYLQAKQSLVPAHPMAPPSPSTTSSNNNSSSSSNSGWDQLSKTNLYIRGLPPHTTDQDLVKLCQPYGKIVSTKAILDKTTNKCKGYGFVDFDSPAAAQKAVSALKASGVQAQMAKQQEQDPTNLYISNLPLSMDEQELENMLKPFGQVISTRILRDSSGTSRGVGFARMESTEKCEAVIGHFNGKFIKTPPGVSAPTEPLLCKFADGGQKKRQNPNKYIPNGRPWHREGEAGMTLTYDPTTAAIQNGFYPSPYSIATNRMITQTSITPYIASPVSAYQVQSPSWMQPQPYILQHPGAVLTPSMEHTMSLQPASMISPLAQQMSHLSLGSTGTYMPATSAMQGAYLPQYAHMQTTAVPVEEASGQQQVAVETSNDHSPYTFQPNK

SEQ ID NO: 87 - DNA, 4369 bp, Homo sapiens
  CDS (622)..(1398)
cgtgggcgccagaaagcggaacctcccgggccagtcgcgcggtggtcaccctcttgggagctggggaggaggctgcggaggctggcccggctccttcgggcgtcgcttcccggaccgggtgcgcggggtcccccggaacgtgtgttccaggtcctcccgcgccagtgttcgcagtccccgcctggtcgcggcggcgcctcgggcgcgggtgcaggcgcgcggcgcgcaggcggggggcgctgtggtcttggcgcggggaccgagccgctcggccagacccgcctcttttccctccccgccagcccgcccgcctgcccgccccccacgcgtcgtgtcgccgggaagccgggcggagacagagcgcttgggatccacggcgctcggaccgctgtcctccaacagcgcagggcagagcggctggcgccgccggagcgcggagccacgaccctccctggccgcctttgtctactggccgtgcggcccggaaccgccactctccagggccggggacgcgcccgcagctgtcggtgacagctcctccctaccgcaaccctccggggcggaggggcggtcgggccgggccctgctagcccgcgaccgcaagcccgcgctcgcggatcgatgcccccgcagcagggggaccccgcgttccccgaccgctgcgaggcgcctccggtgccgccgcgtcgggagcgcggtggacgcgggggacgcgggcctggggagccggggggccgggggcgtgcggggggtgccgaggggcgcggcgtcaagtgcgtgctggtcggcgacggcgcggtgggcaagacgagcctggtggtgagctacaccaccaacggctaccccaccgagtacatccctactgccttcgacaacttctccgcggtggtgtctgtggatgggcggcccgtgagactccaactctgtgacactgccggacaggatgaatttgacaagctgaggcctctctgctacaccaacacagacatcttcctgctctgcttcagtgtcgtgagcccctcatccttccagaacgtcagtgagaaatgggtgccggagattcgatgccactgtcccaaagcccccatcatcctagttggaacgcagtcggatctcagagaagatgtcaaagtcctcattgagttggacaaatgcaaagaaaagccagtgcctgaagaggcggctaagctgtgcgccgaggaaatcaaagccgcctcctacatcgagtgttcagccttgactcaaaaaaacctcaaagaggtctttgatgcagccatcgtcgctggcattcaatactcggacactcagcaacagccaaagaagtctaaaagcaggactccagataaaatgaaaaacctctccaagtcctggtggaagaagtactgctgtttcgtatgatgctggcaagacacccagaaaggctattttcagatgaaatcgatattagaagctatattagctgaaacaactccttttactgcgtagaacctatatcgagagtgtgtgtatatgtattataggaggagctctcaattttatgtattctttctgcctttaattttcttgtttgtttgagcttagggatgagatacttatgcaagatatttttgaagtaaattaaacatttttcacatctctggaaatttagagttctagacctctggttaatttatatctaatatgaagaagacacctctaatctggatgttaagaatgaagttctgctacattataatgtacagaagagcaaaagggaggaacactatggttaaccctctcttgattaagggctacttaatgcacagtgcattatgtacacaggtcaaccatggtaacaatagttcttagctttgaaactccatgcaaaccatgccttttttttaaggagcaaaaatctgagaaaaaaagtgagagacctctgcctacaaaacctcaaaccagtcacttttgtcaattgctaatacccagttacttatgatttaaaaacaaccaacagaaaacatcccactgactgtatggcactctgtagtcaaaaaaggaaacttccttattgggacttttctttcttagtccagttgtgttgacacatatgaacacagacaaagtgctatgcggaggaaagcaagtgttggtcagtagtttcatgttttagggagtggttcctgtggagatcagaaagtgacatttgctttcggtactgtaatacgtgcaccaaactgcctcaatcctaggtaacgagggcaacagggagcacctgtctggattgtttttaaacctccatactcaagctgtctcttcggcagggaggtgaatactcttgaaaggccaacagcaagtgtttgtgggacacaacacagataattttttcttaagtcggccaagatgtacttctctgtgtgcacacccatgcacactcatgcacacagatacataggtctgtatggctgtatttgctgttgattcagactttcacaccattaatggggaaaagcgtggccacaaaaacagatgctaggaagcttggcttcctcttcttgttgacccttttttgaaccaacatcttttttattatattcagagtatgtttttaagtgtatcttaatatatacattttttaggacatcttaaatctaaacaaaaaataaaatgaacatctcttgaaacctgttaaaacaaccagttaaagccacagatggctttcagggcagtagcagcagaggccagtggactctgaggactcctgaggggcggggcgtgtagccagccaggtgcatgccgggaccatggcccccatacttggctgcttcctgtgacagtgaaatacatccttcaaggtggcagctgttagggctgaatcttctggagaaaaaggtgccatctcaggagaatagcttttactctggtaggaatgcttccgagacaccacaaggcagcctgaacactcagttgcagggtcgggcttgcggtgggtgacccagagccaccaaagtcacatccacaactaatgagggaaatctgtaaagccagttagatagaagaattttatttttctgtgggttttgtgttgtcttttttatgttaaaaagaaatccagtttgtgtttttctatagaaaaagtaaaagatcaggttatactttaggttaggggttctatttattcctgttagtaaataaaattaacaaatttctttgtttaacaaaagattaatctttaaaccactaaaatacatagactgattgattattcaacacattggaattgatgtcggtcatagtttcctgaagcatttagttacaacctgaaggaataaaatgatttgtggaaatgcttaaaatagacctaactgaatacagtctcatcttgccgcgcctggcttacctatctgtggaaagctaggcttcccaggctgggctctgcctgtctggtgcctggaggtgtgggagggaagatgagttatttaactggtaagcgatttgaaacactatttttatattaaagtaaatggcatggagtatagtgcaaattcatttttaagatagaacacaaaacttgaaagaagttttatgcgtgtgacagtgtatggggctgcagttggtctccctggaggggacttccacacctcctgcctttaggccatgggtggaaagtgctcagtgaagtacacctgtgtggcccagttctgaaagctttatacagttgaattttaagtggggttgataacaccttggactgttagtgttaaaaatctagtgggttgacctttaaatgcaacagtttttaaaatatattgctgcattttatagaatagtaaaggtacgattatacttgagattttcctccatttttatttcttcgtgaacatagagtttggggccgaaaatgtttttaaagtatgtgtttgagttaaatataaagttggttcacttcaaagctaaaaaattgttaaacttgcagcttggtattgcagagaagattttataagaattttgctttagagaatgccactttggctgaactacaagtgtaggccaccattataatttataaatacagcatacttcaaaactgtttgttatctcttgttaccatgtatgtataaatggaccttttataaccttgttctctgcttgacagactcaagagaaactacccaggtattacacaagccaaaatgggagcaaggccttctctccagactatcgtaacctggtgccttaccaagttgtgcttttctgttttcaagtgtaaatgatgttgagcagaatgttgtacttgaaaatgctataagtgagatggtatgaaataaattctgacttatgaaaaaaaaaaaaaaaaaaaaaaaaaaaaaaaaaaaaaaaaaaaaaaaaa

SEQ ID NO: 88 - protein, 258 aa, Homo sapiens
MPPQQGDPAFPDRCEAPPVPPRRERGGRGGRGPGEPGGRGRAGGAEGRGVKCVLVGDGAVGKTSLVVSYTTNGYPTEYIPTAFDNFSAVVSVDGRPVRLQLCDTAGQDEFDKLRPLCYTNTDIFLLCFSVVSPSSFQNVSEKWVPEIRCHCPKAPIILVGTQSDLREDVKVLIELDKCKEKPVPEEAAKLCAEEIKAASYIECSALTQKNLKEVFDAAIVAGIQYSDTQQQPKKSKSRTPDKMKNLSKSWWKKYCCFV

SEQ ID NO: 89 - DNA, 3782 bp, Homo sapiens
  CDS (246)..(2537)
ttctgcccttcccccgcttaggggggcgggggtaggggaaaggaaaataatacaatttcaggggaagtcgccttcaggtctgctgcttttttattttttttttttaattaaaaaaaaaaaggacatagaaaacatcagtcttgaacttctcttcaagaacccgggctgcaaaggaaatctcctttgtttttgttatttatgtgctgtcaagttttgaagtggtgatctttagacagtgactgagtatggatcatttgaacgaggcaactcaggggaaagaacattcagaaatgtctaacaatgtgagtgatccgaagggtccaccagccaagattgcccgcctggagcagaacgggagcccgctaggaagaggaaggcttgggagtacaggtgcaaaaatgcagggagtgcctttaaaacactcgggccatctgatgaaaaccaaccttaggaaaggaaccatgctgccagttttctgtgtggtggaacattatgaaaacgccattgaatatgattgcaaggaggagcatgcagaatttgtgctggtgagaaaggatatgcttttcaaccagctgatcgaaatggcattgctgtctctaggttattcacatagctctgctgcccaggccaaagggctaatccaggttggaaagtggaatccagttccactgtcttacgtgacagatgcccctgatgctacagtagcagatatgcttcaagatgtgtatcatgtggtcacattgaaaattcagttacacagttgccccaaactagaagacttgcctcccgaacaatggtcgcacaccacagtgaggaatgctctgaaggacttactgaaagatatgaatcagagttcattggccaaggagtgccccctttcacagagtatgatttcttccattgtgaacagtacttactatgcaaatgtctcagcagcaaaatgtcaagaatttggaaggtggtacaaacatttcaagaagacaaaagatatgatggttgaaatggatagtctttctgagctatcccagcaaggcgccaatcatgtcaattttggccagcaaccagttccagggaacacagccgagcagcctccatcccctgcgcagctctcccatggcagccagccctctgtccggacacctcttccaaacctgcaccctgggctcgtatcaacacctatcagtcctcaattggtcaaccagcagctggtgatggctcagctgctgaaccagcagtatgcagtgaatagacttttagcccagcagtccttaaaccaacaatacttgaaccaccctccccctgtcagtagatctatgaataagcctttggagcaacaggtttcgaccaacacagaggtgtcttccgaaatctaccagtgggtacgcgatgaactgaaacgagcaggaatctcccaggcggtatttgcacgtgtggcttttaacagaactcagggcttgctttcagaaatcctccgaaaggaagaggaccccaagactgcatcccagtctttgctggtaaaccttcgggctatgcagaatttcttgcagttaccggaagctgaaagagaccgaatataccaggacgaaagggaaaggagcttgaatgctgcctcggccatgggtcctgcccccctcatcagcacaccacccagccgtcctccccaggtgaaaacagctactattgccactgaaaggaatgggaaaccagagaacaataccatgaacattaatgcttccatttatgatgagattcagcaggaaatgaagcgtgctaaagtgtctcaagcactgtttgcaaaggttgcagcaaccaaaagccagggatggttgtgcgagctgttacgctggaaagaagatccttctccagaaaacagaaccctgtgggagaacctctccatgatccgaaggttcctcagtcttcctcagccagaacgtgatgccatttatgaacaggagagcaacgcggtgcatcaccatggcgacaggccgccccacattatccatgttccagcagagcagattcagcaacagcagcagcaacagcaacagcagcagcagcagcagcaggcaccgccgcctccacagccacagcagcagccacagacaggccctcggctccccccacggcaacccacggtggcctctccagcagagtcagatgaggaaaaccgacagaagacccggccacgaacaaaaatttcagtggaagccttgggaatcctccagagtttcatacaagacgtgggcctgtaccctgacgaagaggccatccagactctgtctgcccagctcgaccttcccaagtacaccatcatcaagttctttcagaaccagcggtactatctcaagcaccacggcaaactgaaggacaattccggtttagaggtcgatgtggcagaatataaagaagaggagctgctgaaggatttggaagagagtgtccaagataaaaatactaacacccttttttcagtgaaactagaagaagagctgtcagtggaaggaaacacagacattaatactgatttgaaagactgagataaaagtatttgtttcgttcaacagtgccactggtatttactaacaaaatgaaaagtccaccttgtcttctctcagaaaacctttgttgttcattgtttggccaatgaatcttcaaaaacttgcacaaacagaaaagttggaaaaggataatacagactgcactaaatgttttcctctgttttacaaactgcttggcagccccaggtgaagcatcaaggattgtttggtattaaaatttgtgttcacgggatgcaccaaagtgtgtaccccgtaagcatgaaaccagtgttttttgttttttttttagttcttattccggagcctcaaacaagcattataccttctgtgattatgatttcctctcctataattatttctgtagcactccacactgatctttggaaacttgccccttatttaaaaaaaaaaaagaaaaaaaagagtttgttactctattgtatgttacaaaagaactatagactgtggaatgcagtttaaagatgacatatgccaacaaatgccttgtattatatggcactgccgtaattcaaatttgtttttattttggaaataaaagttcactgtacttttttttcattctcattgttacatgattttttaaaaaaaggaaaagaaaatgtgaaacacaatttagtcctcattatttatttgtagatcctgcagcatcatgttgtaattaattttttggaagtttccgttaaatgtaatattgcttctcttgttaccatactgattcttttctatttataaatgtattttgatgggcagtaaaacaaagtgtcttaaaagttttaaatagagaaaatgtgctttacacagttgcctataaaaagtgctctatgttatccaagcaattcatactataagcttcactcttattgttgtatgcaatttttactatcatgcaaataagcttaggtaaataaaactaatagatcaccttagaaaattatgcaattaatgtgaaaataattgatgtttgcaatgtgtcttcctttggtttacaatcaattttaaagctacatctgtataaaatttctgtataaaggtgtatttcttttttatgagtttatggctatgaaaacagctattttgttacagctggctgtttttataagtgtatcacaattttctttatgcagaaatgttctgactaggagtggttattgactgtaactacacaattaaaattgtttgtatcgtaaaaaaaaaaaaaaaaaa

SEQ ID NO: 90 - protein, 763 aa, Homo sapiens
MDHLNEATQGKEHSEMSNNVSDPKGPPAKIARLEQNGSPLGRGRLGSTGAKMQGVPLKHSGHLMKTNLRKGTMLPVFCVVEHYENAIEYDCKEEHAEFVLVRKDMLFNQLIEMALLSLGYSHSSAAQAKGLIQVGKWNPVPLSYVTDAPDATVADMLQDVYHVVTLKIQLHSCPKLEDLPPEQWSHTTVRNALKDLLKDMNQSSLAKECPLSQSMISSIVNSTYYANVSAAKCQEFGRWYKHFKKTKDMMVEMDSLSELSQQGANHVNFGQQPVPGNTAEQPPSPAQLSHGSQPSVRTPLPNLHPGLVSTPISPQLVNQQLVMAQLLNQQYAVNRLLAQQSLNQQYLNHPPPVSRSMNKPLEQQVSTNTEVSSEIYQWVRDELKRAGISQAVFARVAFNRTQGLLSEILRKEEDPKTASQSLLVNLRAMQNFLQLPEAERDRIYQDERERSLNAASAMGPAPLISTPPSRPPQVKTATIATERNGKPENNTMNINASIYDEIQQEMKRAKVSQALFAKVAATKSQGWLCELLRWKEDPSPENRTLWENLSMIRRFLSLPQPERDAIYEQESNAVHHHGDRPPHIIHVPAEQIQQQQQQQQQQQQQQQAPPPPQPQQQPQTGPRLPPRQPTVASPAESDEENRQKTRPRTKISVEALGILQSFIQDVGLYPDEEAIQTLSAQLDLPKYTIIKFFQNQRYYLKHHGKLKDNSGLEVDVAEYKEEELLKDLEESVQDKNTNTLFSVKLEEELSVEGNTDINTDLKD

SEQ ID NO: 91 - DNA, 3199 bp, Homo sapiens
  CDS (96)..(2588)
gtttttctaaacagcctgacactgaggggaggcagtgagactgtaagcagtctgggttgggcagaaggcagaaaaccagcagagtcacagaggagatggccaactgccaaatagccatcttgtaccagagattccagagagtggtctttggaatttcccaactcctttgcttcagtgccctgatctctgaactaacaaaccagaaagaagtggcagcatggacttatcattacagcacaaaagcatactcatggaatatttcccgtaaatactgccagaatcgctacacagacttagtggccatccagaataaaaatgaaattgattacctcaataaggtcctaccctactacagctcctactactggattgggatccgaaagaacaataagacatggacatgggtgggaaccaaaaaggctctcaccaacgaggctgagaactgggctgataatgaacctaacaacaaaaggaacaacgaggactgcgtggagatatacatcaagagtccgtcagcccctggcaagtggaatgatgagcactgcttgaagaaaaagcacgcattgtgttacacagcctcctgccaggacatgtcctgcagcaaacaaggagagtgcctcgagaccatcgggaactacacctgctcctgttaccctggattctatgggccagaatgtgaatacgtgagagagtgtggagaacttgagctccctcaacacgtgctcatgaactgcagccaccctctgggaaacttctcttttaactcgcagtgcagcttccactgcactgacgggtaccaagtaaatgggcccagcaagctggaatgcttggcttctggaatctggacaaataagcctccacagtgtttagctgcccagtgcccacccctgaagattcctgaacgaggaaacatgatctgccttcattctgcaaaagcattccagcatcagtctagctgcagcttcagttgtgaagagggatttgcattagttggaccggaagtggtgcaatgcacagcctcgggggtatggacagccccagccccagtgtgtaaagctgtgcagtgtcagcacctggaagcccccagtgaaggaaccatggactgtgttcatccgctcactgcttttgcctatggctccagctgcaaatttgagtgccagcccggctacagagtgaggggcttggacatgctccgctgcattgactctggacactggtctgcacccttgccaacctgtgaggctatttcgtgtgagccgctggagagtcctgtccacggaagcatggattgctctccatccttgagagcgtttcagtatgacaccaactgtagcttccgctgtgctgaaggtttcatgctgagaggagccgatatagttcggtgtgataacttgggacagtggacagcaccagccccagtctgtcaagctttgcagtgccaggatctcccagttccaaatgaggcccgggtgaactgctcccaccccttcggtgcctttaggtaccagtcagtctgcagcttcacctgcaatgaaggcttgctcctggtgggagcaagtgtgctacagtgcttggctactggaaactggaattctgttcctccagaatgccaagccattccctgcacacctttgctaagccctcagaatggaacaatgacctgtgttcaacctcttggaagttccagttataaatccacatgtcaattcatctgtgacgagggatattctttgtctggaccagaaagattggattgtactcgatcgggacgctggacagactccccaccaatgtgtgaagccatcaagtgcccagaactctttgccccagagcagggcagcctggattgttctgacactcgtggagaattcaatgttggctccacctgtcatttctcttgtaacaatggctttaagctggaggggcccaataatgtggaatgcacaacttctggaagatggtcagctactccaccaacctgcaaaggcatagcatcacttcctactccagggttgcaatgtccagccctcaccactcctgggcagggaaccatgtactgtaggcatcatccgggaacctttggttttaataccacttgttactttggctgcaacgctggattcacactcataggagacagcactctcagctgcagaccttcaggacaatggacagcagtaactccagcatgcagagctgtgaaatgctcagaactacatgttaataagccaatagcgatgaactgctccaacctctggggaaacttcagttatggatcaatctgctctttccattgtctagagggccagttacttaatggctctgcacaaacagcatgccaagagaatggccactggtcaactaccgtgccaacctgccaagcaggaccattgactatccaggaagccctgacttactttggtggagcggtggcttctacaataggtctgataatgggtgggacgctcctggctttgctaagaaagcgtttcagacaaaaagatgatgggaaatgccccttgaatcctcacagccacctaggaacatatggagtttttacaaacgctgcatttgacccgagtccttaaggtttccataaacacccatgaatcaaagacatggaattaccttagattagctctggaccagcctgttggacccgctctggaccaaccctgtttcctgagtttgggattgtggtacaatctcaaattctcaacctaccaccccttcctgtcccacctcttctcttcctgtaacacaagccacagaagccaggagcaaatgtttctgcagtagtctctgtgctttgactcacctgttacttgaaataccagtgaaccaaagagactggagcatctgactcacaagaagaccagactgtggagaaataaaaatacctctttattttttgattgaaggaaggttttctccactttgttggaaagcaggtggcatctctaattggaagaaattcctgtagcatcttctggagtctccagtggttgctgttgatgaggcctcttggacctctgctctgaggcttccagagagtcctctggatggcaccagaggctgcagaaggccaagaatcaagctagaaggccacatgtcaccgtggaccttcctgccaccagtcactgtccctcaaatgacccaaagaccaatattcaaatgcgtaattaaaagaattttcccc

SEQ ID NO: 92 - protein, 830 aa, Homo sapiens
MANCQIAILYQRFQRVVFGISQLLCFSALISELTNQKEVAAWTYHYSTKAYSWNISRKYCQNRYTDLVAIQNKNEIDYLNKVLPYYSSYYWIGIRKNNKTWTWVGTKKALTNEAENWADNEPNNKRNNEDCVEIYIKSPSAPGKWNDEHCLKKKHALCYTASCQDMSCSKQGECLETIGNYTCSCYPGFYGPECEYVRECGELELPQHVLMNCSHPLGNFSFNSQCSFHCTDGYQVNGPSKLECLASGIWTNKPPQCLAAQCPPLKIPERGNMICLHSAKAFQHQSSCSFSCEEGFALVGPEVVQCTASGVWTAPAPVCKAVQCQHLEAPSEGTMDCVHPLTAFAYGSSCKFECQPGYRVRGLDMLRCIDSGHWSAPLPTCEAISCEPLESPVHGSMDCSPSLRAFQYDTNCSFRCAEGFMLRGADIVRCDNLGQWTAPAPVCQALQCQDLPVPNEARVNCSHPFGAFRYQSVCSFTCNEGLLLVGASVLQCLATGNWNSVPPECQAIPCTPLLSPQNGTMTCVQPLGSSSYKSTCQFICDEGYSLSGPERLDCTRSGRWTDSPPMCEAIKCPELFAPEQGSLDCSDTRGEFNVGSTCHFSCNNGFKLEGPNNVECTTSGRWSATPPTCKGIASLPTPGLQCPALTTPGQGTMYCRHHPGTFGFNTTCYFGCNAGFTLIGDSTLSCRPSGQWTAVTPACRAVKCSELHVNKPIAMNCSNLWGNFSYGSICSFHCLEGQLLNGSAQTACQENGHWSTTVPTCQAGPLTIQEALTYFGGAVASTIGLIMGGTLLALLRKRFRQKDDGKCPLNPHSHLGTYGVFTNAAFDPSP

SEQ ID NO: 93 - DNA, 4700 bp, Homo sapiens
  CDS (1)..(2349)
atggccccctcggcctgggccatttgctggctgctagggggcctcctgctccatgggggtagctctggccccagccccggccccagtgtgccccgcctgcggctctcctaccgagacctcctgtctgccaaccgctctgccatctttctgggcccccagggctccctgaacctccaggccatgtacctagatgagtaccgagaccgcctctttctgggtggcctggacgccctctactctctgcggctggaccaggcatggccagatccccgggaggtcctgtggccaccgcagccaggacagagggaggagtgtgttcgaaagggaagagatcctttgacagagtgcgccaacttcgtgcgggtgctacagcctcacaaccggacccacctgctagcctgtggcactggggccttccagcccacctgtgccctcatcacagttggccaccgtggggagcatgtgctccacctggagcctggcagtgtggaaagtggccgggggcggtgccctcacgagcccagccgtccctttgccagcaccttcatagacggggagctgtacacgggtctcactgctgacttcctggggcgagaggccatgatcttccgaagtggaggtcctcggccagctctgcgttccgactctgaccagagtctcttgcacgacccccggtttgtgatggccgcccggatccctgagaactctgaccaggacaatgacaaggtgtacttcttcttctcggagacggtcccctcgcccgatggtggctcgaaccatgtcactgtcagccgcgtgggccgcgtctgcgtgaatgatgctgggggccagcgggtgctggtgaacaaatggagcactttcctcaaggccaggctggtctgctcggtgcccggccctggtggtgccgagacccactttgaccagctagaggatgtgttcctgctgtggcccaaggccgggaagagcctcgaggtgtacgcgctgttcagcaccgtcagtgccgtgttccagggcttcgccgtctgtgtgtaccacatggcagacatctgggaggttttcaacgggccctttgcccaccgagatgggcctcagcaccagtgggggccctatgggggcaaggtgcccttccctcgccctggcgtgtgccccagcaagatgaccgcacagccaggacggccttttggcagcaccaaggactacccagatgaggtgctgcagtttgcccgagcccaccccctcatgttctggcctgtgcggcctcgacatggccgccctgtccttgtcaagacccacctggcccagcagctacaccagatcgtggtggaccgcgtggaggcagaggatgggacctacgatgtcattttcctggggactgactcagggtctgtgctcaaagtcatcgctctccaggcagggggctcagctgaacctgaggaagtggttctggaggagctccaggtgtttaaggtgccaacacctatcaccgaaatggagatctctgtcaaaaggcaaatgctatacgtgggctctcggctgggtgtggcccagctgcggctgcaccaatgtgagacttacggcactgcctgtgcagagtgctgcctggcccgggacccatactgtgcctgggatggtgcctcctgtacccactaccgccccagccttggcaagcgccggttccgccggcaggacatccggcacggcaaccctgccctgcagtgcctgggccagagccaggaagaagaggcagtgggacttgtggcagccaccatggtctacggcacggagcacaatagcaccttcctggagtgcctgcccaagtctccccaggctgctgtgcgctggctcttgcagaggccaggggatgaggggcctgaccaggtgaagacggacgagcgagtcttgcacacggagcgggggctgctgttccgcaggcttagccgtttcgatgcgggcacctacacctgcaccactctggagcatggcttctcccagactgtggtccgcctggctctggtggtgattgtggcctcacagctggacaacctgttccctccggagccaaagccagaggagcccccagcccggggaggcctggcttccaccccacccaaggcctggtacaaggacatcctgcagctcattggcttcgccaacctgccccgggtggatgagtactgtgagcgcgtgtggtgcaggggcaccacggaatgctcaggctgcttccggagccggagccggggcaagcaggccaggggcaagagctgggcagggctggagctaggcaagaagatgaagagccgggtgcatgccgagcacaatcggacgccccgggaggtggaggccacgtagaagggggcagaggaggggtggtcaggatgggctggggggcccactagcagcccccagcatctcccacccacccagctagggcagaggggtcaggatgtctgtttgcctcttagagacaggtgtctctgcccccacaccgctactggggtctaatggaggggctgggttcttgaagcctgttccctgcccttctctgtgctcttagacccagctggagccagcaccctctggctgctggcagccccaagggatctgccatttgttctcagagatggcctggcttccgcaacacatttccgggtgtgcccagaggcaagagggttgggtggttctttcccagcctacagaacaatggccattctgagtgaccctcagagtgggtgtgtgggtgcgtctagggggtatcccggtagggggcctgcagggagccagagggtggaaatggcctctaagctagcaccccgtaagaagagcctacctgaccgacttggggagggaacacagaggtgttgggaaggtggagcaacaatgcacctcccctcctgtcgcgccgtgatatcttggtggctccctgccactgcccaccgcctcttctccatctgagaatcacggagaggtgtagataatctagaggcatagactgctagagcccccagggatctggggtggtcagggctcaggcttcactttgtaaaccaggtgggggcatctcacagcctgacttcccttccccaggccagggttgctgggatgcctgcccctcctgagaggaccccctccccattgtcaggctctccatgtccacgagcggggaggggtgggttctggggcattgttgtcccttgtgtctgtggactagagatagggtgggggagctggggaagggtgcaggcgggaagagtgggctgtctttcccagggtgatgcaagcatgccgcagccctggaggctgggaatgtggaggctctgtgagccctgcagccctcagaatcagggccagggatgcagaagattgagaggatatggagatggatagagggcaggagacccttaggatagattgtgggacccaggcaggaacaggtgtccacaagaactcaggatggcatcagttagctcagaagccacctggaagacccagtgtttccatctctggaatctctgttttatgctaaatggatttaggaagactgtttttcttttaagggggaaacaaggtagagaaaaggacgaagaagtgtaagtcccgctgattctcgggggtaaggctcggatggcaaggacgcgttctgcctgggcatgtaggggaggtgtttttgccatcaccagtttctcaggctggggagcacagaggggaggaggaggactaaatgaaaagttgttcccagcctgcacatgaacacattcatgacacacaaaactggctggaaggagataagagcactgggtttgagattccctccattaaaacaaccaagacaaagaaaggaggggaaaaaaagataaaaagcaagccagggttccctgccctattgaaactcaaacccagactgccttgggttttatctttcccttacccctggcacctccagagaactgggacctgaaatagtccctccgttctcccctttgaccatgtaataaatgaaccagaagcactgagattaacctatcaacgccctgagaagccttccagcctgcggtgctgtctgctgggaggtcagctggtcaaggcagaggaggagaggaggaaaggatgggggctgaagagcagaagggaggggagacagaggggattaaagaggggaggagagagtgcagagctccaggaaagggtatcagagctgcagccagctctgccctctaccctagggaggccagaaagacacaaacagccctccgggcctttacgctggactctggcttggcaggctccaggcagggtcctctgggaagttactctagaaaacgaagggaggaggagcacaagatcctcagcaacgaacacctgcacttagaaaaagtggacagcttctgccaaccacaccctacccatggtactgtatgctattaactcctggaaacgccccgtaaatgcgagttgtttttgtatttgtgtgttgagatgggccttgtggtttctctgtactcagagcacatttcttgtaattactattgttatttttattgtcatgactgcccctgagctctggtgagaaaagctgaatttacaaggaaagggatgaagttaatatttgcatcacataattatatcattactgtgtatctgtgtattgtactaaatggactgatgctgcgcacatgagctgaaaatgaagagccctcccatcc

SEQ ID NO: 94 - protein, 782 aa, Homo sapiens
MAPSAWAICWLLGGLLLHGGSSGPSPGPSVPRLRLSYRDLLSANRSAIFLGPQGSLNLQAMYLDEYRDRLFLGGLDALYSLRLDQAWPDPREVLWPPQPGQREECVRKGRDPLTECANFVRVLQPHNRTHLLACGTGAFQPTCALITVGHRGEHVLHLEPGSVESGRGRCPHEPSRPFASTFIDGELYTGLTADFLGREAMIFRSGGPRPALRSDSDQSLLHDPRFVMAARIPENSDQDNDKVYFFFSETVPSPDGGSNHVTVSRVGRVCVNDAGGQRVLVNKWSTFLKARLVCSVPGPGGAETHFDQLEDVFLLWPKAGKSLEVYALFSTVSAVFQGFAVCVYHMADIWEVFNGPFAHRDGPQHQWGPYGGKVPFPRPGVCPSKMTAQPGRPFGSTKDYPDEVLQFARAHPLMFWPVRPRHGRPVLVKTHLAQQLHQIVVDRVEAEDGTYDVIFLGTDSGSVLKVIALQAGGSAEPEEVVLEELQVFKVPTPITEMEISVKRQMLYVGSRLGVAQLRLHQCETYGTACAECCLARDPYCAWDGASCTHYRPSLGKRRFRRQDIRHGNPALQCLGQSQEEEAVGLVAATMVYGTEHNSTFLECLPKSPQAAVRWLLQRPGDEGPDQVKTDERVLHTERGLLFRRLSRFDAGTYTCTTLEHGFSQTVVRLALVVIVASQLDNLFPPEPKPEEPPARGGLASTPPKAWYKDILQLIGFANLPRVDEYCERVWCRGTTECSGCFRSRSRGKQARGKSWAGLELGKKMKSRVHAEHNRTPREVEAT

SEQ ID NO: 95 - DNA, 2113 bp, Homo sapiens
  CDS (11)..(1525)
ccgagttgcgatgctgtacttctctttgttttgggcggctcggcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagaacttctgcagccgagctgcgctggaggccctggggtcctgtctgaacaacaagtactcggagggttatcctggcaagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaaccccaaaactggcctcattgactacaaccagctggcactgactgctcgacttttccggccacggctcatcatagctggcaccagcgcctatgctcgcctcattgactacgcccgcatgagagaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccaggtcagggctcatcttctaccggaaaggggtgaaggctgtggaccccaagactggccgggagatcccttacacatttgaggaccgaatcaactttgccgtgttcccatccctgcaggggggcccccacaatcatgccattgctgcagtagctgtggccctaaagcaggcctgcacccccatgttccgggagtactccctgcaggttctgaagaatgctcgggccatggcagatgccctgctagagcgaggctactcactggtatcaggtggtactgacaaccacctggtgctggtggacctgcggcccaagggcctggatggagctcgggctgagcgggtgctagagcttgtatccatcactgccaacaagaacacctgtcctggagaccgaagtgccatcacaccgggcggcctgcggcttggggccccagccttaacttctcgacagttccgtgaggatgacttccggagagttgtggactttatagatgaaggggtcaacattggcttagaggtgaagagcaagactgccaagctccaggatttcaaatccttcctgcttaaggactcagaaacaagtcagcgtctggccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggtaacaagacttagaaggagggcccaggcactttctgtttgaacccctgtcatgatcacagtgtcagagacgcgtcctctttcttggggaagttgaggagtgcccttcagagccagtagcaggcaggggtgggtaggcaccctccttcctgtttttatctaataaaatgctaacctgccctgagtttccattactgtgggtggggttcccctgggccaaacagtgatttgtctccctcaatgtgtacaccgctccgctcccaccaccgctaccacaaggacccccggggctgcagcctcctctttctgtctctgatcagagccgacaccagacgtgattagcaggcgcagcaaattcaatttgttaaatgaaattgtattttgaaaaaaaaaaaaaaaaaa

SEQ ID NO: 96 - protein, 504 aa, Homo sapiens
MLYFSLFWAARPLQRCGQLVRMAIRAQHSNAAQTQTGEANRGWTGQESLSDSDPEMWELLQREKDRQCRGLELIASENFCSRAALEALGSCLNNKYSEGYPGKRYYGGAEVVDEIELLCQRRALEAFDLDPAQWGVNVQPYSGSPANLAVYTALLQPHDRIMGLDLPDGGHLTHGYMSDVKRISATSIFFESMPYKLNPKTGLIDYNQLALTARLFRPRLIIAGTSAYARLIDYARMREVCDEVKAHLLADMAHISGLVAAKVIPSPFKHADIVTTTTHKTLRGARSGLIFYRKGVKAVDPKTGREIPYTFEDRINFAVFPSLQGGPHNHAIAAVAVALKQACTPMFREYSLQVLKNARAMADALLERGYSLVSGGTDNHLVLVDLRPKGLDGARAERVLELVSITANKNTCPGDRSAITPGGLRLGAPALTSRQFREDDFRRVVDFIDEGVNIGLEVKSKTAKLQDFKSFLLKDSETSQRLANLRQRVEQFARAFPMPGFDEH

SEQ ID NO: 97 - DNA, 2967 bp, Homo sapiens
  CDS (217)..(1839)
tagctccgcgcgggggcttcctcggctccttgctgttgccgccgccgcagctgctgccgcggttggtggggttgggtgagaggaggagctgtcgcggaccctgtagagtcggtctctgttgctctttttgcctgaggagtcttccatcctacgtcgagctctgactcccgtgctgtcgagagggagtccccggggacacctcggcacgcagcggagatgcctctttttgccaccaatcccttcgatcaggatgttgagaaagcaaccagcgagatgaatactgctgaggactggggcctcattttggatatctgtgataaagttggtcagtctcgcactggacctaaggattgtcttcggtctattatgagaagagtgaaccacaaagatcctcacgttgctatgcaggctttgactcttctaggagcatgtgtatcaaactgtggcaaaatttttcatttagaagtatgttcaagagattttgctagtgaagtaagcaacgtattaaataagggtcatcctaaagtatgtgaaaaattaaaggctcttatggttgaatggacagatgaatttaagaatgatccacagcttagtctaatatcagcaatgattaagaaccttaaggaacaaggagttacgttcccagctattggctctcaggctgcagaacaagcaaaagcaagcccagctcttgtagccaaggatcctggtactgtggctaacaaaaaagaagaagaagatttagcaaaagccattgagttgtctctcaaggaacaaaggcagcagtcaaccaccctttccactttgtatccaagcacatccagtctcttaactaaccaccaacatgaaggccgaaaagttcgtgctatatatgactttgaagctgctgaagacaatgaacttacttttaaagctggagaaattattacagttcttgatgacagtgatcctaactggtggaaaggtgaaacccatcaaggcatagggttatttccttctaattttgtgactgcagatctcactgctgaaccagaaatgattaaaacagagaagaagacggtacaatttagtgatgatgttcaggtagagacaatagaaccagagccggaaccagcctttattgatgaagataaaatggaccagttgctacagatgctgcaaagtacagaccccagtgatgatcagccagacctaccagagctgcttcatcttgaagcaatgtgtcaccagatgggacctctcattgatgaaaagctggaagatattgatagaaaacattcagaactctcagaacttaatgtgaaagtgatggaggccctttccttatataccaagttaatgaacgaagatccgatgtattccatgtatgcaaagttacagaatcagccatattatatgcagtcatctggtgtttctggttctcaggtgtatgcagggcctcctccaagtggtgcctacctggttgcagggaacgcgcagatgagccacctccagagctacagtcttcccccggagcagctgtcttctctcagccaggcagtggtcccaccatccgcaaacccagcccttcctagtcagcagactcaggccgcttacccaaatacaatggtcagttccgttcaaggaaacacatatcccagccaggcgccagtatatagtcctcctcctgccgctactgctgctgctgcaactgccgatgtcactctgtaccagaatgcaggacctaatatgccccaggtgccaaactataacttaacatcatcaactctgcctcagcccggaggcagccaacagccacctcagccacagcaaccatattctcagaaggctctgctataggacccggtgttcctcttggtggcagatacctgctaaatgccactgacaatgttatgagattcattactatcttaagatgtgtttatcctcagcttataggaatctctccaggtcaacaggttcaaatattcaagaaggtagaactctcctcaatttacactgactttttagaggttcttccccccccgcccctgcagaggaatgaaactacttacaacatttaattcctttcataatatgaaagaattgatacaaggctatttgtctcgtaaacctggtctgcagaaagtcaaacttacaaaaactgttgtgacaaatgttatgtacatatattgatatgtaactgcattagtggccattttgaatcacagtggtgatcgtgtgaatatatttaacactgtgttaaattaatttacgttgctattttattttaatcataaacaactaccatgtttcttaatgttttgtgtaaatttaaggtaattatactatccttttaaacttcaagaaaacaaagttgttagcgtatttacatgaaggcgcattatgttgtcgtgtgtttcagtttcacattaaactgaaccttttactaattgtgagctaaagagatatatatatatatgtgtgtgtatatatatatatctacatgtctttctgtagcctctgcatactactggctgtcatcacaccagcgtacagtagctaaatttttggtgcaattatagcaaatgataatgttcccttttgaacttttacattttggcatgacatttcagagtattgtgggaccatgagacaaaattaagtacgatcacattctttatttctcattttaaagaaatgatgttggtttaccttttcctagttgaagatagtaattaggtttctaagctgtatactgtgtttattggtggcagtgacaccaaagatagaggcaatggatagaaatttttaaactggaaagaaaacctgaattacactacattttcgaagtctcttgtaattatttgggatatcaacaaaatttgattcgtctgtctaatcccttgctagtattttaaatatgtctttaacacattgtatcctttaattcttcattaaaatggaaataagtagatgtttcaaagt

SEQ ID NO: 98 - protein, 540 aa, Homo sapiens
MPLFATNPFDQDVEKATSEMNTAEDWGLILDICDKVGQSRTGPKDCLRSIMRRVNHKDPHVAMQALTLLGACVSNCGKIFHLEVCSRDFASEVSNVLNKGHPKVCEKLKALMVEWTDEFKNDPQLSLISAMIKNLKEQGVTFPAIGSQAAEQAKASPALVAKDPGTVANKKEEEDLAKAIELSLKEQRQQSTTLSTLYPSTSSLLTNHQHEGRKVRAIYDFEAAEDNELTFKAGEIITVLDDSDPNWWKGETHQGIGLFPSNFVTADLTAEPEMIKTEKKTVQFSDDVQVETIEPEPEPAFIDEDKMDQLLQMLQSTDPSDDQPDLPELLHLEAMCHQMGPLIDEKLEDIDRKHSELSELNVKVMEALSLYTKLMNEDPMYSMYAKLQNQPYYMQSSGVSGSQVYAGPPPSGAYLVAGNAQMSHLQSYSLPPEQLSSLSQAVVPPSANPALPSQQTQAAYPNTMVSSVQGNTYPSQAPVYSPPPAATAAAATADVTLYQNAGPNMPQVPNYNLTSSTLPQPGGSQQPPQPQQPYSQKALL

SEQ ID NO: 99 - DNA, 3108 bp, Homo sapiens
  CDS (81)..(947)
gcctctggctcctcagggcattcccggcggctccgggtttggcaacgaggacgggggagtgcgactgcgtctcgggcagcatggccgagaagcggcacacacgggactccgaagcccagcggctccccgactccttcaaggacagccccagtaagggccttggaccttgcggatggattttggtggcgttctcattcttattcaccgttataactttcccaatctcaatatggatgtgcataaagattataaaagagtatgaaagagccatcatctttagattgggtcgcattttacaaggaggagccaaaggacctggtttgttttttattctgccatgcactgacagcttcatcaaagtggacatgagaactatttcatttgatattcctcctcaggagatcctcacaaaggattcagtgacaattagcgtggatggtgtggtctattaccgcgttcagaatgcaaccctggctgtggcaaatatcaccaacgctgactcagcaacccgtcttttggcacaaactactctgaggaatgttctgggcaccaagaatctttctcagatcctctctgacagagaagaaattgcacacaacatgcagtctactctggatgatgccactgatgcctggggaataaaggtggagcgtgtggaaattaaggatgtgaaactacctgtgcagctccagagagctatggctgcagaagcagaagcgtcccgcgaggcccgcgccaaggttattgcagccgaaggagaaatgaatgcatccagggctctgaaagaagcctccatggtcatcactgaatctcctgcagcccttcagctccgatacctgcagacactgaccaccattgctgctgagaaaaactcaacaattgtcttccctctgcccatagatatgctgcaaggaatcataggggcaaaacacagccatctaggctagtgtagagatgagcgctagccttccaagcatgaagtcggggaccaaattagcctttaactcataaagagagggtagggcttttctttttccatatgtcaattgtggtgttcccagaatgtatagcagttataaaaataggtgaaagaattgttagcttgtaaatactgagagattggtgatttatataaggtaatctgttagtcttaaaatagttaaaagtttgtatttttagattattatgtagtaggttagatccctcttgttttgacttccactgactcattctgaaccccctaagcacccaggccagaggcaagaacctgggctgtaactgccacctgacaccgctgactggctaaatgctttgcagaaagtgatgaccttacaccacaaccagcttctccaggtcatatgtgccttacctccagagagtctttttttttttttttctgagatggagtttcactcttgttgcccaggctggagtgcaatagcatgatctcggctcactgcaacctccgcctcctgggttcaagagattctcctgcctcagcctccccagtagctgggattacaggctcatgccaccatgcccagctaatttttgtattattattattgttttttagtagagacggggtttcaccatgttggccaggctagtcacgaactcctaacctcaggtgatccacccacctctgcctcccaaagtgctgggattacaggcatgagctaccacacctggtttggagagtcttaattaaggaaatttccctaatgttcatttattttctaaatccagaccgtgtttcagaataatccttacttgagagtagccattttcttgcctgtacttgtcagaactagaggaaatagccaagactaatgaaaaagattactctaacccttaaaagacttttaaattcactactagagtggtcattttaaaaatacatccatgttttaacttatttgagccttctttatgagtaaatgattcctccttgttctgtctttcaaaccagctaaatatttgtcacaaaagtgcttttttctcactgttgcctattttcatatatcaggttttaaatagttttaattttttaataaaattttctctacgttctatatgcaattgttatatatctatttgaatagctgaaggactaaaatacttttttaagagataacttcaggaaaccattatattttactatctgcatgctgttaactgtggtacactgtgaaatatgttgattacaaacccattcattacatagtataaggaattcacagtatattgactatatagtgtctaatgatcttgggcagatactgtcaaacttacaatatctatatagatgtaggtctttttaaatttacctagtcattcttctatcatgtatattgatgctgaaagaggaactggtcagctcctctggacaacaaattcttagtctataatattaggagacatcttctgttttgcaaatgtctgtgaatctgagcaacctggcattctgcttactggccagaaagctggcgggtgacatttgtaacatttcctctttgagactctgagttcacctagagaagtctaagcataacagctttctttcccagcacgagcctttatagctctctttagctcaaccactctgtccatccagccaatggatgtcccttcccctgtaccccaatttcaagcttattttaggaagccttgaactaccatgtatcctggctcctagctgagtttattagaggtatggagcagtgcaacttaaactcaagttgcacttacattttgaattttaaaatgatggttttatctgttgtgtgaagtggttcacccttgaggaccaggagcctccatatcctgactgaaaaccttttctgagacttagagtaacagtgcttttggttccttgagttctcctgtctccagataccaaatgaccttgacttttctgccttgtgaattcgtagtccaatcagctgaaattaaatcacttgggagggacgcatagaaggagctctaggaacacagtgccagtgcagaagtttctccaggtggcctccctttccaacaatgtacataataaagtgtatgcactttcactaataaaaaaaaaaaaaaaaaaaaaaaaaaaaaaaaaaa

SEQ ID NO: 100 - protein, 288 aa, Homo sapiens [sequence omitted]

SEQ ID NO: 101 - DNA, 2593 bp, Homo sapiens
  CDS (81)..(452)
gcctctggctcctcagggcattcccggcggctccgggtttggcaacgaggacgggggagtgcgactgcgtctcgggcagcatggccgagaagcggcacacacgggactccgaagcccagcggctccccgactccttcaaggacagccccagtaagggccttggaccttgcggatggattttggtggcgttctcattcttattcaccgttataactttcccaatctcaatatggatgtgcataaaggttattgcagccgaaggagaaatgaatgcatccagggctctgaaagaagcctccatggtcatcactgaatctcctgcagcccttcagctccgatacctgcagacactgaccaccattgctgctgagaaaaactcaacaattgtcttccctctgcccatagatatgctgcaaggaatcataggggcaaaacacagccatctaggctagtgtagagatgagcgctagccttccaagcatgaagtcggggaccaaattagcctttaactcataaagagagggtagggcttttctttttccatatgtcaattgtggtgttcccagaatgtatagcagttataaaaataggtgaaagaattgttagcttgtaaatactgagagattggtgatttatataaggtaatctgttagtcttaaaatagttaaaagtttgtatttttagattattatgtagtaggttagatccctcttgttttgacttccactgactcattctgaaccccctaagcacccaggccagaggcaagaacctgggctgtaactgccacctgacaccgctgactggctaaatgctttgcagaaagtgatgaccttacaccacaaccagcttctccaggtcatatgtgccttacctccagagagtctttttttttttttttctgagatggagtttcactcttgttgcccaggctggagtgcaatagcatgatctcggctcactgcaacctccgcctcctgggttcaagagattctcctgcctcagcctccccagtagctgggattacaggctcatgccaccatgcccagctaatttttgtattattattattgttttttagtagagacggggtttcaccatgttggccaggctagtcacgaactcctaacctcaggtgatccacccacctctgcctcccaaagtgctgggattacaggcatgagctaccacacctggtttggagagtcttaattaaggaaatttccctaatgttcatttattttctaaatccagaccgtgtttcagaataatccttacttgagagtagccattttcttgcctgtacttgtcagaactagaggaaatagccaagactaatgaaaaagattactctaacccttaaaagacttttaaattcactactagagtggtcattttaaaaatacatccatgttttaacttatttgagccttctttatgagtaaatgattcctccttgttctgtctttcaaaccagctaaatatttgtcacaaaagtgcttttttctcactgttgcctattttcatatatcaggttttaaatagttttaattttttaataaaattttctctacgttctatatgcaattgttatatatctatttgaatagctgaaggactaaaatacttttttaagagataacttcaggaaaccattatattttactatctgcatgctgttaactgtggtacactgtgaaatatgttgattacaaacccattcattacatagtataaggaattcacagtatattgactatatagtgtctaatgatcttgggcagatactgtcaaacttacaatatctatatagatgtaggtctttttaaatttacctagtcattcttctatcatgtatattgatgctgaaagaggaactggtcagctcctctggacaacaaattcttagtctataatattaggagacatcttctgttttgcaaatgtctgtgaatctgagcaacctggcattctgcttactggccagaaagctggcgggtgacatttgtaacatttcctctttgagactctgagttcacctagagaagtctaagcataacagctttctttcccagcacgagcctttatagctctctttagctcaaccactctgtccatccagccaatggatgtcccttcccctgtaccccaatttcaagcttattttaggaagccttgaactaccatgtatcctggctcctagctgagtttattagaggtatggagcagtgcaacttaaactcaagttgcacttacattttgaattttaaaatgatggttttatctgttgtgtgaagtggttcacccttgaggaccaggagcctccatatcctgactgaaaaccttttctgagacttagagtaacagtgcttttggttccttgagttctcctgtctccagataccaaatgaccttgacttttctgccttgtgaattcgtagtccaatcagctgaaattaaatcacttgggagggacgcatagaaggagctctaggaacacagtgccagtgcagaagtttctccaggtggcctccctttccaacaatgtacataataaagtgtatgcactttcactaaaaaaaaaaaaaaaaaa

SEQ ID NO: 102 - protein, 123 aa, Homo sapiens
MAEKRHTRDSEAQRLPDSFKDSPSKGLGPCGWILVAFSFLFTVITFPISIWMCIKVIAAEGEMNASRALKEASMVITESPAALQLRYLQTLTTIAAEKNSTIVFPLPIDMLQGIIGAKHSHLG

SEQ ID NO: 103 - DNA, 1027 bp, Homo sapiens
  CDS (74)..(250)
gggcaagagttgggcaaaaaaatcaaggtatttggtcccggaacaaagcttatcattacagataaacaacttgatgcagatgtttcccccaagcccactatttttcttccttcaattgctgaaacaaagctccagaaggctggaacatacctttgtcttcttgagaaatttttccctgatgttattaagatacattggcaagaaaagaagagcaacacgattctgggatcccaggaggggaacaccatgaagactaacgacacatacatgaaatttagctggttaacggtgccagaaaagtcactggacaaagaacacagatgtatcgtcagacatgagaataataaaaacggagttgatcaagaaattatctttcctccaataaagacagatgtcatcacaatggatcccaaagacaattgttcaaaagatgcaaatgatacactactgctgcagctcacaaacacctctgcatattacatgtacctcctcctgctcctcaagagtgtggtctattttgccatcatcacctgctgtctgcttagaagaacggctttctgctgcaatggagagaaatcataacagacggtggcacaaggaggccatcttttcctcatcggttattgtccctagaagcgtcttctgaggatctagttgggctttctttctgggtttgggccatttcagttctcatgtgtgtactattctatcattattgtataacggttttcaaaccagtgggcacacagagaacctcactctgtaataacaatgaggaatagccacggcgatctccagcaccaatctctccatgttttccacagctcctccagccaacccaaatagcgcctgctatagtgtagacatcctgcggcttctagccttgtccctctcttagtgttctttaatcagataactgcctggaagcctttcattttacacgccctgaagcagtcttctttgctagttgaattatgtggtgtgtttttccgtaataagcaaaataaatttaaaaaaatgaaaagtt

SEQ ID NO: 104 - protein, 58 aa, Homo sapiens
MQMFPPSPLFFFLQLLKQSSRRLEHTFVFLRNFSLMLLRYIGKKRRATRFWDPRRGTP

SEQ ID NO: 105 - DNA, 1027 bp, Homo sapiens; identical to SEQ ID NO: 103
  CDS (247)..(582)

SEQ ID NO: 106 - protein, 111 aa, Homo sapiens
MKTNDTYMKFSWLTVPEKSLDKEHRCIVRHENNKNGVDQEIIFPPIKTDVITMDPKDNCSKDANDTLLLQLTNTSAYYMYLLLLLKSVVYFAIITCCLLRRTAFCCNGEKS

SEQ ID NO: 107 - DNA, 3283 bp, Homo sapiens
  CDS (197)..(1351)
cccgccagctcgcggagccgctctgccccgcgccctagcccgcgcctgcagcccgcccaggcggagtcagcccgcgctccgcccgccgcgatccgagctcggaggttcggactccgggctcgccgccccccgggccggctccgcgccccgcactcccggcgcccagcgccccgcgccccggcgggcggagcgcaccatgccgcagctggactccggcgggggcggcgcgggcggcggcgacgacctcggcgcgccggacgagctgctggccttccaggatgaaggcgaggagcaggacgacaagagccgcgacagcgccgccggtcccgagcgcgacctggccgagctcaagtcgtcgctcgtgaacgagtccgagggcgcggccggcggcgcagggatcccgggggtcccgggggccggcgccggggcccgcggcgaggccgaggctctcgggcgggaacacgctgcgcagagactcttcccggacaaacttccagagcccctggaggacggcctgaaggccccggagtgcaccagcggcatgtacaaagagaccgtctactccgccttcaatctgctcatgcattacccacccccctcgggagcagggcagcacccccagccgcagcccccgctgcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggttcacccacccatccttgatgctaggttctggtgtacctggtcacccagcagccatcccccacccggccattgtgcccccctcagggaagcaggagctgcagcccttcgaccgcaacctgaagacacaagcagagtccaaggcagagaaggaggccaagaagccaaccatcaagaagcccctcaatgccttcatgctgtacatgaaggagatgagagccaaggtcattgcagagtgcacacttaaggagagcgctgccatcaaccagatcctgggccgcaggtggcacgcgctgtcgcgagaagagcaggccaagtactatgagctggcccgcaaggagaggcagctgcacatgcagctatacccaggctggtcagcgcgggacaactacgggaagaagaagaggcggtcgagggaaaagcaccaagaatccaccacaggaggaaaaagaaatgcattcggtacttacccggagaaggccgctgccccagccccgttccttccgatgacagtgctctaggctgccccgggtccccagctccccaggactcaccctcataccatctgctgccccgcttccccacagaactgcttactagccctgcggagccggcacctacatccccaggtctctccactgctctcagcctcccaaccccagggcccccacaggccccccgcagcaccctgcagagcacacaggtacagcaacaggaatctcagagacaggtggcctagcaggcacaggacacctggccgcctccaggagcctaccccctgaaagtgacagagacccagatctcatggaaactggccaggggtcctgttaacgtcatctcagggtccagaccctgaagatttcagaggctgcaggacttctgcctgaacctggggtcatcgattcaaactgctccaagtggtgggaatcagatctgtcttgatgtgtcatctaattaagggaatcccttgtacctatggctgcctgcatctattctttgtaccatctgtcttgccagccagaagcctctgcctccctagcttttctgctataggtcagagatgggctgaactgagcctagctaccttctctacccatctcccccatcccccactgccacaccctccccattcagacacttcatggaccaagaatgagctggtttgtcaaacaacatgtgagcatggtcacaagcacaaagctcaagatgacagctcttctaaggaaatggagaagctctgtttataaaaacaaaaacaaaaccagctgctactcataagttggaccagaggaagccccttactatgatctcaggagcttgcaagaagcaggaaggggaatggaataggttaagtttaggcctatcaacctaagcaacagaaataatctgacactaccttatcaggcaaattggggaggggagggtgtatctagctctagttcaaattatttggaagtgttccctgagaaacccaccagcctaagaagctctggccccaggcttgtcactagcagctgcagtcaacagttcaaagaagtcatggcccaaatccagtgtgcacccctccccattcacagagcctttttcacaattccatttccagttcatctatggcagtccagccagctcctgggcagcttgagagggcaaacccaaaacctcatgacagccagagcctgtctttcagcattcagtccgcctggccggctccagtttccccatggggctgcgggacagaggaccattacaactagatcaaggagcccagaaaacctccagtagtggacaacaggttttcaccatagcctacgttaacccatttttgagccaagcttcaaccctcagccttgaaaaacaagtctttaatttaatttttgttttttgcctaaatccaaagaaaaagggctgccgggccaggcgcggtggctcacgcctgtaatcccagcactttggcaggccgaggcaggtggatcacctgacgtcagtagtttgagaccagcctggccaacatggtgaaaccctgtatctactaaaaatacaaaaattagccggacgtggtggtgcgcgcatgtaatcccagctactcgggaggctgaggcggaagaatcacttgaacccgggaggcggaggttccagtgagccgagatggcgctattgcactccagtctgggtaacagggagactgcatctcaaaaaaaaaaaaaaaaaaaaaaaagggctgtccatgtattcacacacccctcaaaaaaagcctttagttcctactttagccactggtttctcagaatccaaagatcacatattctagtgtaacactgcaagaagtcttgagaaaaagattattgtagtgttcaaaatatttttgtattgttaatgcatcatcatagaaaaacttttaaacatgagaataaagatactttttactgggtttgtttttcaaagcctgaaaaaaa

SEQ ID NO: 108 - protein, 384 aa, Homo sapiens
MPQLDSGGGGAGGGDDLGAPDELLAFQDEGEEQDDKSRDSAAGPERDLAELKSSLVNESEGAAGGAGIPGVPGAGAGARGEAEALGREHAAQRLFPDKLPEPLEDGLKAPECTSGMYKETVYSAFNLLMHYPPPSGAGQHPQPQPPLHKANQPPHGVPQLSLYEHFNSPHPTPAPADISQKQVHRPLQTPDLSGFYSLTSGSMGQLPHTVSWFTHPSLMLGSGVPGHPAAIPHPAIVPPSGKQELQPFDRNLKTQAESKAEKEAKKPTIKKPLNAFMLYMKEMRAKVIAECTLKESAAINQILGRRWHALSREEQAKYYELARKERQLHMQLYPGWSARDNYGKKKRRSREKHQESTTGGKRNAFGTYPEKAAAPAPFLPMTVL

SEQ ID NO: 109 - DNA, 2821 bp, Homo sapiens
  CDS (80)..(889)
gcccaggtgactgactaatccgccgccttcaggagacagaattggccaaggcctgaaggccccggagtgcaccagcggcatgtacaaagagaccgtctactccgccttcaatctgctcatgcattacccacccccctcgggagcagggcagcacccccagccgcagcccccgctgcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggttcacccacccatccttgatgctaggttctggtgtacctggtcacccagcagccatcccccacccggccattgtgcccccctcagggaagcaggagctgcagcccttcgaccgcaacctgaagacacaagcagagtccaaggcagagaaggaggccaagaagccaaccatcaagaagcccctcaatgccttcatgctgtacatgaaggagatgagagccaaggtcattgcagagtgcacacttaaggagagcgctgccatcaaccagatcctgggccgcaggtggcacgcgctgtcgcgagaagagcaggccaagtactatgagctggcccgcaaggagaggcagctgcacatgcagctatacccaggctggtcagcgcgggacaactacgggaagaagaagaggcggtcgagggaaaagcaccaagaatccaccacaggaggaaaaagaaatgcattcggtacttacccggagaaggccgctgccccagccccgttccttccgatgacagtgctctaggctgccccgggtccccagctccccaggactcaccctcataccatctgctgccccgcttccccacagaactgcttactagccctgcggagccggcacctacatccccaggtctctccactgctctcagcctcccaaccccagggcccccacaggccccccgcagcaccctgcagagcacacaggtacagcaacaggaatctcagagacaggtggcctagcaggcacaggacacctggccgcctccaggagcctaccccctgaaagtgacagagacccagatctcatggaaactggccaggggtcctgttaacgtcatctcagggtccagaccctgaagatttcagaggctgcaggacttctgcctgaacctggggtcatcgattcaaactgctccaagtggtgggaatcagatctgtcttgatgtgtcatctaattaagggaatcccttgtacctatggctgcctgcatctattctttgtaccatctgtcttgccagccagaagcctctgcctccctagcttttctgctataggtcagagatgggctgaactgagcctagctaccttctctacccatctcccccatcccccactgccacaccctccccattcagacacttcatggaccaagaatgagctggtttgtcaaacaacatgtgagcatggtcacaagcacaaagctcaagatgacagctcttctaaggaaatggagaagctctgtttataaaaacaaaaacaaaaccagctgctactcataagttggaccagaggaagccccttactatgatctcaggagcttgcaagaagcaggaaggggaatggaataggttaagtttaggcctatcaacctaagcaacagaaataatctgacactaccttatcaggcaaattggggaggggagggtgtatctagctctagttcaaattatttggaagtgttccctgagaaacccaccagcctaagaagctctggccccaggcttgtcactagcagctgcagtcaacagttcaaagaagtcatggcccaaatccagtgtgcacccctccccattcacagagcctttttcacaattccatttccagttcatctatggcagtccagccagctcctgggcagcttgagagggcaaacccaaaacctcatgacagccagagcctgtctttcagcattcagtccgcctggccggctccagtttccccatggggctgcgggacagaggaccattacaactagatcaaggagcccagaaaacctccagtagtggacaacaggttttcaccatagcctacgttaacccatttttgagccaagcttcaaccctcagccttgaaaaacaagtctttaatttaatttttgttttttgcctaaatccaaagaaaaagggctgccgggccaggcgcggtggctcacgcctgtaatcccagcactttggcaggccgaggcaggtggatcacctgacgtcagtagtttgagaccagcctggccaacatggtgaaaccctgtatctactaaaaatacaaaaattagccggacgtggtggtgcgcgcatgtaatcccagctactcgggaggctgaggcggaagaatcacttgaacccgggaggcggaggttccagtgagccgagatggcgctattgcactccagtctgggtaacagggagactgcatctcaaaaaaaaaaaaaaaaaaaaaaaagggctgtccatgtattcacacacccctcaaaaaaagcctttagttcctactttagccactggtttctcagaatccaaagatcacatattctagtgtaacactgcaagaagtcttgagaaaaagattattgtagtgttcaaaatatttttgtattgttaatgcatcatcatagaaaaacttttaaacatgagaataaagatactttttactgggtttgtttttcaaagcctgaaaaaaa

SEQ ID NO: 110 - protein, 269 aa, Homo sapiens
MYKETVYSAFNLLMHYPPPSGAGQHPQPQPPLHKANQPPHGVPQLSLYEHFNSPHPTPAPADISQKQVHRPLQTPDLSGFYSLTSGSMGQLPHTVSWFTHPSLMLGSGVPGHPAAIPHPAIVPPSGKQELQPFDRNLKTQAESKAEKEAKKPTIKKPLNAFMLYMKEMRAKVIAECTLKESAAINQILGRRWHALSREEQAKYYELARKERQLHMQLYPGWSARDNYGKKKRRSREKHQESTTGGKRNAFGTYPEKAAAPAPFLPMTVL

SEQ ID NO: 111 - DNA, 1254 bp, Homo sapiens
  CDS (80)..(889)
gcccaggtgactgactaatccgccgccttcaggagacagaattggccaaggcctgaaggccccggagtgcaccagcggcatgtacaaagagaccgtctactccgccttcaatctgctcatgcattacccacccccctcgggagcagggcagcacccccagccgcagcccccgctgcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggttcacccacccatccttgatgctaggttctggtgtacctggtcacccagcagccatcccccacccggccattgtgcccccctcagggaagcaggagctgcagcccttcgaccgcaacctgaagacacaagcagagtccaaggcagagaaggaggccaagaagccaaccatcaagaagcccctcaatgccttcatgctgtacatgaaggagatgagagccaaggtcattgcagagtgcacacttaaggagagcgctgccatcaaccagatcctgggccgcaggtggcacgcgctgtcgcgagaagagcaggccaagtactatgagctggcccgcaaggagaggcagctgcacatgcagctatacccaggctggtcagcgcgggacaactacgggaagaagaagaggcggtcgagggaaaagcaccaagaatccaccacagagacaaactggcccagagaactcaaggatggtaatggacaagagtcactgtccatgtcttcttcctctagcccagcttgaggactgggatggctgggcaaggaagccataggcattgcggccccttgccttggtgcagatgtgagtcccacaaacacatctggagaagctcaaaggccgggactgggagatgactcccttggaagacaggagagatgactcccttggaagacagatgacagcccataggcctagtgacaaaaggcccctttccgaccttgtggctgttctgggaactgcacctgtcctaggtctgggccagaccaagcagaatggcagtctgaggacactgacttaccacccaagtcccaggaagagaggacaaggaatcagccaggcctgtgcaaaggcagcattttttggttgtggagtatgactatgaattc

SEQ ID NO: 112 - protein, 269 aa, Homo sapiens
MYKETVYSAFNLLMHYPPPSGAGQHPQPQPPLHKANQPPHGVPQLSLYEHFNSPHPTPAPADISQKQVHRPLQTPDLSGFYSLTSGSMGQLPHTVSWFTHPSLMLGSGVPGHPAAIPHPAIVPPSGKQELQPFDRNLKTQAESKAEKEAKKPTIKKPLNAFMLYMKEMRAKVIAECTLKESAAINQILGRRWHALSREEQAKYYELARKERQLHMQLYPGWSARDNYGKKKRRSREKHQESTTETNWPRELKDGNGQESLSMSSSSSPA

SEQ ID NO: 113 - DNA, 2917 bp, Homo sapiens
  CDS (80)..(886)
gcccaggtgactgactaatccgccgccttcaggagacagaattggccaaggcctgaaggccccggagtgcaccagcggcatgtacaaagagaccgtctactccgccttcaatctgctcatgcattacccacccccctcgggagcagggcagcacccccagccgcagcccccgctgcacaaggccaatcagcccccccacggtgtcccccaactctctctctacgaacatttcaacagcccacatcccacccctgcacctgcggacatcagccagaagcaagttcacaggcctctgcagacccctgacctctctggcttctactccctgacctcaggcagcatggggcagctcccccacactgtgagctggttcacccacccatccttgatgctaggttctggtgtacctggtcacccagcagccatcccccacccggccattgtgcccccctcagggaagcaggagctgcagcccttcgaccgcaacctgaagacacaagcagagtccaaggcagagaaggaggccaagaagccaaccatcaagaagcccctcaatgccttcatgctgtacatgaaggagatgagagccaaggtcattgcagagtgcacacttaaggagagcgctgccatcaaccagatcctgggccgcaggtggcacgcgctgtcgcgagaagagcaggccaagtactatgagctggcccgcaaggagaggcagctgcacatgcagctatacccaggctggtcagcgcgggacaactacgggaagaagaagaggcggtcgagggaaaagcaccaagaatccaccacagaccctggctcgcctaagaaatgccgtgctcgctttggcctcaaccagcagacggattggtgtggtccgtgcagataactctcttcactattcctaggaggaaaaagaaatgcattcggtacttacccggagaaggccgctgccccagccccgttccttccgatgacagtgctctaggctgccccgggtccccagctccccaggactcaccctcataccatctgctgccccgcttccccacagaactgcttactagccctgcggagccggcacctacatccccaggtctctccactgctctcagcctcccaaccccagggcccccacaggccccccgcagcaccctgcagagcacacaggtacagcaacaggaatctcagagacaggtggcctagcaggcacaggacacctggccgcctccaggagcctaccccctgaaagtgacagagacccagatctcatggaaactggccaggggtcctgttaacgtcatctcagggtccagaccctgaagatttcagaggctgcaggacttctgcctgaacctggggtcatcgattcaaactgctccaagtggtgggaatcagatctgtcttgatgtgtcatctaattaagggaatcccttgtacctatggctgcctgcatctattctttgtaccatctgtcttgccagccagaagcctctgcctccctagcttttctgctataggtcagagatgggctgaactgagcctagctaccttctctacccatctcccccatcccccactgccacaccctccccattcagacacttcatggaccaagaatgagctggtttgtcaaacaacatgtgagcatggtcacaagcacaaagctcaagatgacagctcttctaaggaaatggagaagctctgtttataaaaacaaaaacaaaaccagctgctactcataagttggaccagaggaagccccttactatgatctcaggagcttgcaagaagcaggaaggggaatggaataggttaagtttaggcctatcaacctaagcaacagaaataatctgacactaccttatcaggcaaattggggaggggagggtgtatctagctctagttcaaattatttggaagtgttccctgagaaacccaccagcctaagaagctctggccccaggcttgtcactagcagctgcagtcaacagttcaaagaagtcatggcccaaatccagtgtgcacccctccccattcacagagcctttttcacaattccatttccagttcatctatggcagtccagccagctcctgggcagcttgagagggcaaacccaaaacctcatgacagccagagcctgtctttcagcattcagtccgcctggccggctccagtttccccatggggctgcgggacagaggaccattacaactagatcaaggagcccagaaaacctccagtagtggacaacaggttttcaccatagcctacgttaacccatttttgagccaagcttcaaccctcagccttgaaaaacaagtctttaatttaatttttgttttttgcctaaatccaaagaaaaagggctgccgggccaggcgcggtggctcacgcctgtaatcccagcactttggcaggccgaggcaggtggatcacctgacgtcagtagtttgagaccagcctggccaacatggtgaaaccctgtatctactaaaaatacaaaaattagccggacgtggtggtgcgcgcatgtaatcccagctactcgggaggctgaggcggaagaatcacttgaacccgggaggcggaggttccagtgagccgagatggcgctattgcactccagtctgggtaacagggagactgcatctcaaaaaaaaaaaaaaaaaaaaaaaagggctgtccatgtattcacacacccctcaaaaaaagcctttagttcctactttagccactggtttctcagaatccaaagatcacatattctagtgtaacactgcaagaagtcttgagaaaaagattattgtagtgttcaaaatatttttgtattgttaatgcatcatcatagaaaaacttttaaacatgagaataaagatactttttactgggtttgtttttcaaagcctgaaaaaaa

SEQ ID NO: 114 - protein, 268 aa, Homo sapiens
MYKETVYSAFNLLMHYPPPSGAGQHPQPQPPLHKANQPPHGVPQLSLYEHFNSPHPTPAPADISQKQVHRPLQTPDLSGFYSLTSGSMGQLPHTVSWFTHPSLMLGSGVPGHPAAIPHPAIVPPSGKQELQPFDRNLKTQAESKAEKEAKKPTIKKPLNAFMLYMKEMRAKVIAECTLKESAAINQILGRRWHALSREEQAKYYELARKERQLHMQLYPGWSARDNYGKKKRRSREKHQESTTDPGSPKKCRARFGLNQQTDWCGPCR

SEQ ID NO: 115 - DNA, 3682 bp, Homo sapiens
  CDS (90)..(1475)
gcgagcgcagcggagcctggagagaaggcgctgggctgcgagggcgcgagggcgcgagggcagggggcaaccggaccccgcccgcacccatggcgcccgtcgccgtctgggccgcgctggccgtcggactggagctctgggctgcggcgcacgccttgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacttcgctcttccagttggactgattgtgggtgtgacagccttgggtctactaataataggagtggtgaactgtgtcatcatgacccaggtgaaaaagaagcccttgtgcctgcagagagaagccaaggtgcctcacttgcctgccgataaggcccggggtacacagggccccgagcagcagcacctgctgatcacagcgccgagctccagcagcagctccctggagagctcggccagtgcgttggacagaagggcgcccactcggaaccagccacaggcaccaggcgtggaggccagtggggccggggaggcccgggccagcaccgggagctcagattcttcccctggtggccatgggacccaggtcaatgtcacctgcatcgtgaacgtctgtagcagctctgaccacagctcacagtgctcctcccaagccagctccacaatgggagacacagattccagcccctcggagtccccgaaggacgagcaggtccccttctccaaggaggaatgtgcctttcggtcacagctggagacgccagagaccctgctggggagcaccgaagagaagcccctgccccttggagtgcctgatgctgggatgaagcccagttaaccaggccggtgtgggctgtgtcgtagccaaggtgggctgagccctggcaggatgaccctgcgaaggggccctggtccttccaggcccccaccactaggactctgaggctctttctgggccaagttcctctagtgccctccacagccgcagcctccctctgacctgcaggccaagagcagaggcagcgagttgtggaaagcctctgctgccatggcgtgtccctctcggaaggctggctgggcatggacgttcggggcatgctggggcaagtccctgactctctgtgacctgccccgcccagctgcacctgccagcctggcttctggagcccttgggttttttgtttgtttgtttgtttgtttgtttgtttctccccctgggctctgccccagctctggcttccagaaaaccccagcatccttttctgcagaggggctttctggagaggagggatgctgcctgagtcacccatgaagacaggacagtgcttcagcctgaggctgagactgcgggatggtcctggggctctgtgcagggaggaggtggcagccctgtagggaacggggtccttcaagttagctcaggaggcttggaaagcatcacctcaggccaggtgcagtggctcacgcctatgatcccagcactttgggaggctgaggcgggtggatcacctgaggttaggagttcgagaccagcctggccaacatggtaaaaccccatctctactaaaaatacagaaattagccgggcgtggtggcgggcacctatagtcccagctactcagaagcctgaggctgggaaatcgtttgaacccgggaagcggaggttgcagggagccgagatcacgccactgcactccagcctgggcgacagagcgagagtctgtctcaaaagaaaaaaaaaagcaccgcctccaaatgccaacttgtccttttgtaccatggtgtgaaagtcagatgcccagagggcccaggcaggccaccatattcagtgctgtggcctgggcaagataacgcacttctaactagaaatctgccaattttttaaaaaagtaagtaccactcaggccaacaagccaacgacaaagccaaactctgccagccacatccaaccccccacctgccatttgcaccctccgccttcactccggtgtgcctgcagccccgcgcctccttccttgctgtcctaggccacaccatctcctttcagggaatttcaggaactagagatgactgagtcctcgtagccatctctctactcctacctcagcctagaccctcctcctcccccagaggggtgggttcctcttccccactccccaccttcaattcctgggccccaaacgggctgccctgccactttggtacatggccagtgtgatcccaagtgccagtcttgtgtctgcgtctgtgttgcgtgtcgtgggtgtgtgtagccaaggtcggtaagttgaatggcctgccttgaagccactgaagctgggattcctccccattagagtcagccttccccctcccagggccagggccctgcagaggggaaaccagtgtagccttgcccggattctgggaggaagcaggttgaggggctcctggaaaggctcagtctcaggagcatggggataaaggagaaggcatgaaattgtctagcagagcaggggcagggtgataaattgttgataaattccactggacttgagcttggcagctgaactattggagggtgggagagcccagccattaccatggagacaagaagggttttccaccctggaatcaagatgtcagactggctggctgcagtgacgtgcacctgtactcaggaggctgaggggaggatcactggagcccaggagtttgaggctgcagcgagctatgatcgcgccactacactccagcctgagcaacagagtgagaccctgtctcttaaagaaaaaaaaagtcagactgctgggactggccaggtttctgcccacattggacccacatgaggacatgatggagcgcacctgccccctggtggacagtcctgggagaacctcaggcttccttggcatcacagggcagagccgggaagcgatgaatttggagactctgtggggccttggttcccttgtgtgtgtgtgttgatcccaagacaatgaaagtttgcactgtatgctggacggcattcctgcttatcaataaacctgtttgttttaaaaaaaa

SEQ ID NO: 116 - protein, 461 aa, Homo sapiens
MAPVAVWAALAVGLELWAAAHALPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDFALPVGLIVGVTALGLLIIGVVNCVIMTQVKKKPLCLQREAKVPHLPADKARGTQGPEQQHLLITAPSSSSSSLESSASALDRRAPTRNQPQAPGVEASGAGEARASTGSSDSSPGGHGTQVNVTCIVNVCSSSDHSSQCSSQASSTMGDTDSSPSESPKDEQVPFSKEECAFRSQLETPETLLGSTEEKPLPLGVPDAGMKPS

SEQ ID NO: 117 - DNA, 2920 bp, Homo sapiens
  CDS (558)..(2252)
gatttatggaaagcacctggtgcgtgttctgccctctgaggaccctgccctttcccaaaaggggtatcttaagaaggaaaatatggctgctctttgccggacagcagagtcccagtaggatttccattttccaaacctggtatcatctcctagttggaagaagtggtaagcccacgaacacaaatgcaggagggagaggtgccaagaagcagcggtacacagcaggcacagagacacgtggtcttcagcagagcctatggggttcagatgattcacataagaatagaagtttcagggctggacctggggaggcagcctgagcctgagccggctgtcctgagcctgagtactctagctgccttgtcgtcatcgcatctggctgccatccagcgccagcacacagtaatgagtggccgagcttcctctgggagggaggaaacagttaaaatcttgcagcagctgcaatcatctaggcgtggttctcttgtctgacttgggctgcacagatcctgggccaagggacagaagaaagacagcctaggagcagagcctcccagatggctgagttggatctaatggctccagggccactgcccagggccactgctcagcccccagcccctctcagcccagactctgggtcacccagcccagattctgggtcagccagcccagtggaagaagaggacgtgggctcctcggagaagcttggcagggagacggaggaacaggacagcgactctgcagagcagggggatcctgctggtgaggggaaagaggtcctgtgtgacttctgccttgatgacaccagaagagtgaaggcagtgaagtcctgtctaacctgcatggtgaattactgtgaagagcacttgcagccgcatcaggtgaacatcaaactgcaaagccacctgctgaccgagccagtgaaggaccacaactggcgatactgccctgcccaccacagcccactgtctgccttctgctgccctgatcagcagtgcatctgccaggactgttgccaggagcacagtggccacaccatagtctccctggatgcagcccgcagggacaaggaggctgaactccagtgcacccagttagacttggagcggaaactcaagttgaatgaaaatgccatctccaggctccaggctaaccaaaagtctgttctggtgtcggtgtcagaggtcaaagcggtggctgaaatgcagtttggggaactccttgctgctgtgaggaaggcccaggccaatgtgatgctcttcttagaggagaaggagcaagctgcgctgagccaggccaacggtatcaaggcccacctggagtacaggagtgccgagatggagaagagcaagcaggagctggagaggatggcggccatcagcaacactgtccagttcttggaggagtactgcaagtttaagaacactgaagacatcaccttccctagtgtttacgtagggctgaaggataaactctcgggcatccgcaaagttatcacggaatccactgtacacttaatccagttgctggagaactataagaaaaagctccaggagttttccaaggaagaggagtatgacatcagaactcaagtgtctgccgttgttcagcgcaaatattggacttccaaacctgagcccagcaccagggaacagttcctccaatatgcgtatgacatcacgtttgacccggacacagcacacaagtatctccggctgcaggaggagaaccgcaaggtcaccaacaccacgccctgggagcatccctacccggacctccccagcaggttcctgcactggcggcaggtgctgtcccagcagagtctgtacctgcacaggtactattttgaggtggagatcttcggggcaggcacctatgttggcctgacctgcaaaggcatcgaccggaaaggggaggagcgcaacagttgcatttccggaaacaacttctcctggagcctccaatggaacgggaaggagttcacggcctggtacagtgacatggagaccccactcaaagctggccctttccggaggctcggggtctatatcgacttcccgggagggatcctttccttctatggcgtagagtatgataccatgactctggttcacaagtttgcctgcaaattttcagaaccagtctatgctgccttctggctttccaagaaggaaaacgccatccggattgtagatctgggagaggaacccgagaagccagcaccgtccttggtggggactgctccctagactccaggagccatatcccagacctttgccagctacagtgatgggatttgcattttagggtgatttgggggcagaaataactgctgatggtagctggcttttgaaatcctatggggtctctgaatgaaaacattctccagctgctctcttttgctccatatggtgctgttctctatgtgtttgcagtaattcttttttttttttttgagacggagtctcgcactgttgcccaggctggagagcagtggcgcgatcttggctcactgcaagctccgcctcccgagttcaagcaattctcctgcctcagcctcccgagtagctgggattacaggtgcctgccaccacacccagctaatgttttgtatttttagtagagatggggtttcaccatgttggccaggcagatctcaaactcctgacctcgtgatgcacccacctcggcctcccaaagtgctgggattacatgcgtgagccactgcgccctgcctgtttgtagtaatttttaggcaccaaatctccctcatcttctagtgccattctcctctctgttcaggtaaatgtcacactgtgcccagaatggatgaccaggaaccttaaagagtggctgaaaagattgcagagttatcataataaattgctaacttgcgtaaaaaaaaaaaaaaaaaaaa

SEQ ID NO: 118 - protein, 564 aa, Homo sapiens
MAELDLMAPGPLPRATAQPPAPLSPDSGSPSPDSGSASPVEEEDVGSSEKLGRETEEQDSDSAEQGDPAGEGKEVLCDFCLDDTRRVKAVKSCLTCMVNYCEEHLQPHQVNIKLQSHLLTEPVKDHNWRYCPAHHSPLSAFCCPDQQCICQDCCQEHSGHTIVSLDAARRDKEAELQCTQLDLERKLKLNENAISRLQANQKSVLVSVSEVKAVAEMQFGELLAAVRKAQANVMLFLEEKEQAALSQANGIKAHLEYRSAEMEKSKQELERMAAISNTVQFLEEYCKFKNTEDITFPSVYVGLKDKLSGIRKVITESTVHLIQLLENYKKKLQEFSKEEEYDIRTQVSAVVQRKYWTSKPEPSTREQFLQYAYDITFDPDTAHKYLRLQEENRKVTNTTPWEHPYPDLPSRFLHWRQVLSQQSLYLHRYYFEVEIFGAGTYVGLTCKGIDRKGEERNSCISGNNFSWSLQWNGKEFTAWYSDMETPLKAGPFRRLGVYIDFPGGILSFYGVEYDTMTLVHKFACKFSEPVYAAFWLSKKENAIRIVDLGEEPEKPAPSLVGTAP

SEQ ID NO: 119 - DNA, 652 bp, Homo sapiens
  CDS (82)..(501)
tccccagattgtcattcttcagggatggcagccctaaacacagcatggcaactcatctactcactcatgaaagattaaaaaatggaaaccaacgtatttcatcttatgctctgcgtcacttctgctcggactcataaatccacgtctctttgctttggccacttcaactcatatccaagccttcctttaattcatgatttattgctggaaatatcctttcaactctcagcacctcatgaagacgcgcgcttaactccggaggagctagaaagagcttcccttctacagatactgccagagatgctgggtgcagaaagaggggatattctcaggaaagcagactcaagtaccaacatttttaacccaagaggaaatttgagaaagtttcaggatttctctggacaagatcctaacattttactgagtcatcttttggccagaatctggaaaccatacaagaaacgtgagactcctgattgcttctggaaatactgtgtctgaagtgaaataagcatctgttagtcagctcagaaacacccatcttagaatatgaaaaataacacaatgcttgatttgaaaacagtgtggagaaaaactaggcaaactacaccctgttcattgttacctggaaaataaatcctctatgttttgc

SEQ ID NO: 120 - protein, 139 aa, Homo sapiens
METNVFHLMLCVTSARTHKSTSLCFGHFNSYPSLPLIHDLLLEISFQLSAPHEDARLTPEELERASLLQILPEMLGAERGDILRKADSSTNIFNPRGNLRKFQDFSGQDPNILLSHLLARIWKPYKKRETPDCFWKYCV

SEQ ID NO: 121 - DNA, 652 bp, Homo sapiens; identical to SEQ ID NO: 119
  CDS (82)..(501)

SEQ ID NO: 122 - protein, 139 aa, Homo sapiens; identical to SEQ ID NO: 120

SEQ ID NO: 123 - DNA, 5428 bp, Artificial
  vector pTrcHis FANK1stop
aagggcgaattcaattcgaagcttggctgttttggcggatgagagaagattttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacaaactcttttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcatttacgttgacaccatcgaatggtgcaaaacctttcgcggtatggcatgatagcgcccggaagagagtcaattcagggtggtgaatgtgaaaccagtaacgttatacgatgtcgcagagtatgccggtgtctcttatcagaccgtttcccgcgtggtgaaccaggccagccacgtttctgcgaaaacgcgggaaaaagtggaagcggcgatggcggagctgaattacattcccaaccgcgtggcacaacaactggcgggcaaacagtcgttgctgattggcgttgccacctccagtctggccctgcacgcgccgtcgcaaattgtcgcggcgattaaatctcgcgccgatcaactgggtgccagcgtggtggtgtcgatggtagaacgaagcggcgtcgaagcctgtaaagcggcggtgcacaatcttctcgcgcaacgcgtcagtgggctgatcattaactatccgctggatgaccaggatgccattgctgtggaagctgcctgcactaatgttccggcgttatttcttgatgtctctgaccagacacccatcaacagtattattttctcccatgaagacggtacgcgactgggcgtggagcatctggtcgcattgggtcaccagcaaatcgcgctgttagcgggcccattaagttctgtctcggcgcgtctgcgtctggctggctggcataaatatctcactcgcaatcaaattcagccgatagcggaacgggaaggcgactggagtgccatgtccggttttcaacaaaccatgcaaatgctgaatgagggcatcgttcccactgcgatgctggttgccaacgatcagatggcgctgggcgcaatgcgcgccattaccgagtccgggctgcgcgttggtgcggatatctcggtagtgggatacgacgataccgaagacagctcatgttatatcccgccgttaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtaagttagcgcgaattgatctggtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagcgccgctgagaaaaagcgaagcggcactgctctttaacaatttatcagacaatctgtgtgggcactcgaccggaattatcgattaactttattattaaaaattaaagaggtatatattaatgtatcgattaaataaggaggaataaaccatggggggttctcatcatcatcatcatcatggtatggctagcatgactggtggacagcaaatgggtcgggatctgtacgacgatgacgataaggatccaacccttatggagccccagagaatcatgccaccctcaaagcctcatccacctgtcgtgggcaaagtgactcatcacagcattgaattatactgggatctggaaaagaaagccaaacgccaaggacctcaagagcagtggttcaggttctcgattgaagaagaagaccccaaaatgcacacttatggtatcatttatacgggatatgcaacgaagcatgttgttgaaggtctggaaccaaggacgctgtacagatttcgcctgaaggtcaccagcccctctggggagtgtgagtacagcccactcgtctcagtgtctacaaccagagagcccataagtagtgagcacttgcaccgggctgtcagtgtgaatgatgaagatttgctggtccgaatacttcaaggaggccgtgttaaggttgatgttcccaataagtttggctttaccgctctgatggttgctgcccagaaaggatacaccaggcttgtgaaaatcctagtttctaatggcacagacgtgaatctgaagaatggaagtggcaaggacagtctaatgctggcgtgctatgcgggacacctagatgttgtgaaatatctccgaagacatggcgcttcttggcaggctagagacctgggaggctgtacagctctgcactgggctgcagatggaggccactgcagtgtgattgagtggatgataaaggatggctgtgaggtagacgtcgtggacactggttcaggatggaccccactcatgagagtctctgcggtgtcgggaaatcagagggtggcctctcttctaattgatgctggggccaatgtgaatgtgaaggacagaaatggaaagacgccccttatggtggctgtgttaaataatcatgaagagttagttcagttacttcttgacaaaggggcagatgcaagtgtaaaaaatgagttcggcaaaggtgtcctagaaatggccagagtttttgacagacagagtgtagtctccttattagaagaaaggaaaaaaaagcagaggccaaagaagtcttgtgtctgctga

SEQ ID NO: 124 - DNA, 6220 bp, Artificial
  vector pTrcHis PLEKHK1stop
aagggcgaattcaattcgaagcttggctgttttggcggatgagagaagattttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacaaactcttttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcatttacgttgacaccatcgaatggtgcaaaacctttcgcggtatggcatgatagcgcccggaagagagtcaattcagggtggtgaatgtgaaaccagtaacgttatacgatgtcgcagagtatgccggtgtctcttatcagaccgtttcccgcgtggtgaaccaggccagccacgtttctgcgaaaacgcgggaaaaagtggaagcggcgatggcggagctgaattacattcccaaccgcgtggcacaacaactggcgggcaaacagtcgttgctgattggcgttgccacctccagtctggccctgcacgcgccgtcgcaaattgtcgcggcgattaaatctcgcgccgatcaactgggtgccagcgtggtggtgtcgatggtagaacgaagcggcgtcgaagcctgtaaagcggcggtgcacaatcttctcgcgcaacgcgtcagtgggctgatcattaactatccgctggatgaccaggatgccattgctgtggaagctgcctgcactaatgttccggcgttatttcttgatgtctctgaccagacacccatcaacagtattattttctcccatgaagacggtacgcgactgggcgtggagcatctggtcgcattgggtcaccagcaaatcgcgctgttagcgggcccattaagttctgtctcggcgcgtctgcgtctggctggctggcataaatatctcactcgcaatcaaattcagccgatagcggaacgggaaggcgactggagtgccatgtccggttttcaacaaaccatgcaaatgctgaatgagggcatcgttcccactgcgatgctggttgccaacgatcagatggcgctgggcgcaatgcgcgccattaccgagtccgggctgcgcgttggtgcggatatctcggtagtgggatacgacgataccgaagacagctcatgttatatcccgccgttaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtaagttagcgcgaattgatctggtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagcgccgctgagaaaaagcgaagcggcactgctctttaacaatttatcagacaatctgtgtgggcactcgaccggaattatcgattaactttattattaaaaattaaagaggtatatattaatgtatcgattaaataaggaggaataaaccatggggggttctcatcatcatcatcatcatggtatggctagcatgactggtggacagcaaatgggtcgggatctgtacgacgatgacgataaggatccaacccttatggaggggccgagcctgaggggtcctgcgctccgcctggcggggcttcccacccagcaggactgcaacattcaagaaaaaatagacttagaaattcgaatgcgagaaggaatatggaaactcctttctctgagcactcagaaagatcaagttttacatgcagttaagaatctcatggtgtgcaatgctcgactaatggcctatacatcggagctacagaaattagaagaacagattgcaaatcagactggaagatgtgatgtgaaatttgaaagtaaagaacgaacagcatgtaaaggaaagattgccatatcagatattcgaataccactaatgtggaaagactctgatcacttcagcaataaagaacgatcacgacgctatgccattttttgtttattcaaaatgggagctaatgtgtttgatactgatgtggtgaatgtggataaaacaatcacagatatatgttttgaaaatgtaaccatatttaatgaagcagggccagactttcagataaaggtggaagtgtatagttgctgtacagaagaatcttctataaccaacacaccaaaaaagctagctaagaaactcaagacatctataagtaaagctacaggaaagaaaataagttcagtgcttcaagaagaggatgatgaaatgtgcttgctcctcagctctgctgtttttggtgtaaagtataatttgctagctcacactaccctaaccttggaaagtgctgaggatagtttcaagacccataatctgtctattaatggaaatgaggagtcttcattttggcttcccctgtatggcaacatgtgctgccgactagttgcccagccagcttgtatggctgaggatgcatttgcaggatttcttaatcagcagcaaatggtagaaggtctgattagttggagaaggttgtattgtgttttgcgaggaggtaaactctattgtttttacagtccagaggaaattgaagctaaagtggaaccagctttggtagtacccattaacaaggaaaccagaatccgggcaatggataaggatgccaagaaaagaatccataatttctctgtcatcaatcctgttcctggacaagctataactcagatttttgcagttgacaatagagaagatcttcagaagtggatggaagccttctggcagcatttctttgatcttagccaatggaagcactgttgtgaagaacttatgaaaattgagattatgtcaccacggaaaccacctttgttcttgacaaaagaggcaacctcagtctaccatgatatgagcattgattcacctatgaaacttgaaagtttaacggatataatacaaaaaaaaattgaagagacaaatgggcagttccttattggtcagcatgaagaatccttaccacctccttgggccacactctttgatggtaaccatcaaatggtcatccagaaaaaggtactgtatcctgcaagtgagccattacatgatgaaaaagggaaaaagagacaagctccccttcctccttctgataaacttccattcagcttaaaatcacagagtaacacagatcaattggttaaggacaactggggaaaaacaagtgtatctcagacatcgtctttggataccaaactatcaactctaatgcatcacttacagaaaccaatggctgctcctcgaaaacttctgcctgccaggagaaatagattaagtgatggtgagcacacagacactaaaaccaattttgaagccaagccagtgccagctccaaggcagaaatccatcaaagacattctggaccctagatcatggctgcaggcacaagtatag

SEQ ID NO: 125 - DNA, 5191 bp, Artificial
  vector pTrcHis HPGDstop
aagggcgaattcaattcgaagcttggctgttttggcggatgagagaagattttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacaaactcttttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcatttacgttgacaccatcgaatggtgcaaaacctttcgcggtatggcatgatagcgcccggaagagagtcaattcagggtggtgaatgtgaaaccagtaacgttatacgatgtcgcagagtatgccggtgtctcttatcagaccgtttcccgcgtggtgaaccaggccagccacgtttctgcgaaaacgcgggaaaaagtggaagcggcgatggcggagctgaattacattcccaaccgcgtggcacaacaactggcgggcaaacagtcgttgctgattggcgttgccacctccagtctggccctgcacgcgccgtcgcaaattgtcgcggcgattaaatctcgcgccgatcaactgggtgccagcgtggtggtgtcgatggtagaacgaagcggcgtcgaagcctgtaaagcggcggtgcacaatcttctcgcgcaacgcgtcagtgggctgatcattaactatccgctggatgaccaggatgccattgctgtggaagctgcctgcactaatgttccggcgttatttcttgatgtctctgaccagacacccatcaacagtattattttctcccatgaagacggtacgcgactgggcgtggagcatctggtcgcattgggtcaccagcaaatcgcgctgttagcgggcccattaagttctgtctcggcgcgtctgcgtctggctggctggcataaatatctcactcgcaatcaaattcagccgatagcggaacgggaaggcgactggagtgccatgtccggttttcaacaaaccatgcaaatgctgaatgagggcatcgttcccactgcgatgctggttgccaacgatcagatggcgctgggcgcaatgcgcgccattaccgagtccgggctgcgcgttggtgcggatatctcggtagtgggatacgacgataccgaagacagctcatgttatatcccgccgttaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtaagttagcgcgaattgatctggtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagcgccgctgagaaaaagcgaagcggcactgctctttaacaatttatcagacaatctgtgtgggcactcgaccggaattatcgattaactttattattaaaaattaaagaggtatatattaatgtatcgattaaataaggaggaataaaccatggggggttctcatcatcatcatcatcatggtatggctagcatgactggtggacagcaaatgggtcgggatctgtacgacgatgacgataaggatccaacccttatgcacgtgaacggcaaagtggcgctggtgaccggcgcggctcagggcataggcagagcctttgcagaggcgctgctgcttaagggcgccaaggtagcgctggtggattggaatcttgaagcaggtgtacagtgtaaagctgccctggatgagcagtttgaacctcagaagactctgttcatccagtgcgatgtggctgaccagcaacaactgagagacacttttagaaaagttgtagaccactttggaagactggacattttggtcaataatgctggagtgaataatgagaaaaactgggaaaaaactctgcaaattaatttggtttctgttatcagtggaacctatcttggtttggattacatgagtaagcaaaatggaggtgaaggcggcatcattatcaatatgtcatctttagcaggactcatgcccgttgcacagcagccggtttattgtgcttcaaagcatggcatagttggattcacacgctcagcagcgttggctgctaatcttatgaacagtggtgtgagactgaatgccatttgtccaggctttgttaacacagccatccttgaatcaattgaaaaagaagaaaacatgggacaatatatagaatataaggatcatatcaaggatatgattaaatactatggaattttggacccaccattgattgccaatggattgataacactcattgaagatgatgctttaaatggtgctattatgaagatcacaacttctaagggaattcattttcaagactatgatacaactccatttcaagcaaaaacccaatga

SEQ ID NO: 126 - DNA, 6067 bp, Artificial
  vector pTrcHis DNAPTP6stop
aagggcgaattcaattcgaagcttggctgttttggcggatgagagaagattttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacaaactcttttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcatttacgttgacaccatcgaatggtgcaaaacctttcgcggtatggcatgatagcgcccggaagagagtcaattcagggtggtgaatgtgaaaccagtaacgttatacgatgtcgcagagtatgccggtgtctcttatcagaccgtttcccgcgtggtgaaccaggccagccacgtttctgcgaaaacgcgggaaaaagtggaagcggcgatggcggagctgaattacattcccaaccgcgtggcacaacaactggcgggcaaacagtcgttgctgattggcgttgccacctccagtctggccctgcacgcgccgtcgcaaattgtcgcggcgattaaatctcgcgccgatcaactgggtgccagcgtggtggtgtcgatggtagaacgaagcggcgtcgaagcctgtaaagcggcggtgcacaatcttctcgcgcaacgcgtcagtgggctgatcattaactatccgctggatgaccaggatgccattgctgtggaagctgcctgcactaatgttccggcgttatttcttgatgtctctgaccagacacccatcaacagtattattttctcccatgaagacggtacgcgactgggcgtggagcatctggtcgcattgggtcaccagcaaatcgcgctgttagcgggcccattaagttctgtctcggcgcgtctgcgtctggctggctggcataaatatctcactcgcaatcaaattcagccgatagcggaacgggaaggcgactggagtgccatgtccggttttcaacaaaccatgcaaatgctgaatgagggcatcgttcccactgcgatgctggttgccaacgatcagatggcgctgggcgcaatgcgcgccattaccgagtccgggctgcgcgttggtgcggatatctcggtagtgggatacgacgataccgaagacagctcatgttatatcccgccgttaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtaagttagcgcgaattgatctggtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagcgccgctgagaaaaagcgaagcggcactgctctttaacaatttatcagacaatctgtgtgggcactcgaccggaattatcgattaactttattattaaaaattaaagaggtatatattaatgtatcgattaaataaggaggaataaaccatggggggttctcatcatcatcatcatcatggtatggctagcatgactggtggacagcaaatgggtcgggatctgtacgacgatgacgataaggatccaacccttatggctgaactcaatactcatgtgaatgtcaaggaaaagatctatgcagttagatcagttgttcccaacaaaagcaataatgaaatagtcctggtgctccaacagtttgattttaatgtggataaagccgtgcaagcctttgtggatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacagaaggcaacagactactgcaacagaaactatccttagatgggaaccccaaacctatacatggaacaacagagaggtcagatggcctacagtggtcagctgagcagccttgtaacccaagcaagcctaaggcaaaaacatctcctgttaagtccaatacccctgcagctcatcttgaaataaagccagatgagttggcaaagaaaagaggcccaaatattgagaaatcagtgaaggatttgcaacgctgcaccgtttctctaactagatatcgcgtcatgattaaggaagaagtggatagttccgtgaagaagatcaaagctgcctttgctgaattacacaactgcatcattgacaaagaagtttcattaatggcagaaatggataaagttaaagaagaagccatggaaatcctgactgctcgtcagaagaaagcagaagaactaaagagactcactaaccttgccagtcagatggcagagatgcagctggccgaactcagggcagaaattaagcactttgtcagcgagcgtaaatatgacgaggagctcgggaaagctgcccggttttcctgtgacatcgaacagctgaaggcccaaatcatgctctgcggagaaattacacatccaaagaacaactattcctcaagaactccctgcagctccctgctgcctctgctgaatgcgcacgcagcaacctctgggaaacagagtaacttttcccgaaaatcatccactcacaataagccctctgaaggcaaagcggcaaaccccaaaatggtgagcagtctccccagcaccgccgacccctctcaccagaccatgccggccaacaagcagaatggatcttctaaccaaagacggagatttaatccacagtatcataacaacaggctaaatgggcctgccaagtcgcagggcagtgggaatgaagccgagccactgggaaagggcaacagccgccacgaacacagaagacagccgcacaacggcttccggcccaaaaacaaaggcggtgccaaaaatcaagaggcttccttggggatgaagacccccgaggccccggcccattctgaaaagccccggcgaaggcagcacgctgcagacacctcggaggccaggcccttccggggtagtgtcggtagggtttcacagtgcaatctctgccccacgagaatagaagtttccacagatgcagcagttctctcagtcccggctgtgacgttggtggcctga

SEQ ID NO: 127 - DNA, 4888 bp, Artificial
  vector pTrcHis Col5stop
aagggcgaattcaattcgaagcttggctgttttggcggatgagagaagattttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacaaactcttttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcatttacgttgacaccatcgaatggtgcaaaacctttcgcggtatggcatgatagcgcccggaagagagtcaattcagggtggtgaatgtgaaaccagtaacgttatacgatgtcgcagagtatgccggtgtctcttatcagaccgtttcccgcgtggtgaaccaggccagccacgtttctgcgaaaacgcgggaaaaagtggaagcggcgatggcggagctgaattacattcccaaccgcgtggcacaacaactggcgggcaaacagtcgttgctgattggcgttgccacctccagtctggccctgcacgcgccgtcgcaaattgtcgcggcgattaaatctcgcgccgatcaactgggtgccagcgtggtggtgtcgatggtagaacgaagcggcgtcgaagcctgtaaagcggcggtgcacaatcttctcgcgcaacgcgtcagtgggctgatcattaactatccgctggatgaccaggatgccattgctgtggaagctgcctgcactaatgttccggcgttatttcttgatgtctctgaccagacacccatcaacagtattattttctcccatgaagacggtacgcgactgggcgtggagcatctggtcgcattgggtcaccagcaaatcgcgctgttagcgggcccattaagttctgtctcggcgcgtctgcgtctggctggctggcataaatatctcactcgcaatcaaattcagccgatagcggaacgggaaggcgactggagtgccatgtccggttttcaacaaaccatgcaaatgctgaatgagggcatcgttcccactgcgatgctggttgccaacgatcagatggcgctgggcgcaatgcgcgccattaccgagtccgggctgcgcgttggtgcggatatctcggtagtgggatacgacgataccgaagacagctcatgttatatcccgccgttaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtaagttagcgcgaattgatctggtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagcgccgctgagaaaaagcgaagcggcactgctctttaacaatttatcagacaatctgtgtgggcactcgaccggaattatcgattaactttattattaaaaattaaagaggtatatattaatgtatcgattaaataaggaggaataaaccatggggggttctcatcatcatcatcatcatggtatggctagcatgactggtggacagcaaatgggtcgggatctgtacgacgatgacgataaggatccaacccttatggatgccccgcgaagggacatggagttgctcagcaacagcctggctgcctacgcgcacatccgcgccaaccccgagagcttcggcctctacttcgtgctgggcgtctgcttcggcctgctgctcaccctctgcctgctcgtcatcagcatctcgtgggcgccccgcccgcggccccggggcccggctcagcgccgggacccccgcagcagcaccctggagcccgaggacgacgacgaggacgaggaggacacggtgactcggctgggccccgacgacacgctgccgggccccgagctgtccgcagagccggacgggcccctcaacgtcaacgtcttcacgtcggcggaggagctggagcgggcgcagcggctggaggagcgcgaacggatcctgcgggagatctggcgcaccgggcagccggacctgctgggcacaggcacgctggggcccagccccacggccacgggcaccctgggccgcatgcactattactga

SEQ ID NO: 128 - DNA, 4768 bp, Artificial
  vector pTrcHis col6stop
aagggcgaattcaattcgaagcttggctgttttggcggatgagagaagattttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacaaactcttttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcatttacgttgacaccatcgaatggtgcaaaacctttcgcggtatggcatgatagcgcccggaagagagtcaattcagggtggtgaatgtgaaaccagtaacgttatacgatgtcgcagagtatgccggtgtctcttatcagaccgtttcccgcgtggtgaaccaggccagccacgtttctgcgaaaacgcgggaaaaagtggaagcggcgatggcggagctgaattacattcccaaccgcgtggcacaacaactggcgggcaaacagtcgttgctgattggcgttgccacctccagtctggccctgcacgcgccgtcgcaaattgtcgcggcgattaaatctcgcgccgatcaactgggtgccagcgtggtggtgtcgatggtagaacgaagcggcgtcgaagcctgtaaagcggcggtgcacaatcttctcgcgcaacgcgtcagtgggctgatcattaactatccgctggatgaccaggatgccattgctgtggaagctgcctgcactaatgttccggcgttatttcttgatgtctctgaccagacacccatcaacagtattattttctcccatgaagacggtacgcgactgggcgtggagcatctggtcgcattgggtcaccagcaaatcgcgctgttagcgggcccattaagttctgtctcggcgcgtctgcgtctggctggctggcataaatatctcactcgcaatcaaattcagccgatagcggaacgggaaggcgactggagtgccatgtccggttttcaacaaaccatgcaaatgctgaatgagggcatcgttcccactgcgatgctggttgccaacgatcagatggcgctgggcgcaatgcgcgccattaccgagtccgggctgcgcgttggtgcggatatctcggtagtgggatacgacgataccgaagacagctcatgttatatcccgccgttaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtaagttagcgcgaattgatctggtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagcgccgctgagaaaaagcgaagcggcactgctctttaacaatttatcagacaatctgtgtgggcactcgaccggaattatcgattaactttattattaaaaattaaagaggtatatattaatgtatcgattaaataaggaggaataaaccatggggggttctcatcatcatcatcatcatggtatggctagcatgactggtggacagcaaatgggtcgggatctgtacgacgatgacgataaggatccaacccttatggagccggactttctccactcggtaggggttaagctaccacacacacccccaaacacatgcccacgtgcaagtccctcccacccgccctcccaggggcgaagagaccctgtcccagtggaagtggggaaacccagtcgggtacagaaagcagaggccatggcgcagagcggaggcgcggctttctggggctcagccctagggctacagacccagggcgcggagatgctcgcggccgggccacccaccagagccaggcaaccggcgcttccaggcgagctccgcggggccgaggtgccgggagaagcggccccgggcgcccgcgcgctgcccgacctgggtaacaggcaaagcggagccccggggtcgaagtcctaa

SEQ ID NO: 129 - DNA, 20 bp, Artificial
  primer
atggagccccagagaatcat

SEQ ID NO: 130 - DNA, 21 bp, Artificial
  primer
gcagacacaagacttctttgg

SEQ ID NO: 131 - DNA, 21 bp, Artificial
  primer
tcagcagacacaagacttctt

SEQ ID NO: 132 - DNA, 17 bp, Artificial
  primer
atggaggggccgagcct

SEQ ID NO: 133 - DNA, 19 bp, Artificial
  primer
tacttgtgcctgcagccat

SEQ ID NO: 134 - DNA, 20 bp, Artificial
  primer
ctatacttgtgcctgcagcc

SEQ ID NO: 135 - DNA, 20 bp, Artificial
  primer
atgcacgtgaacggcaaagt

SEQ ID NO: 136 - DNA, 22 bp, Artificial
  primer
ttgggtttttgcttgaaatgga

SEQ ID NO: 137 - DNA, 23 bp, Artificial
  primer
tcattgggtttttgcttgaaatg

SEQ ID NO: 138 - DNA, 22 bp, Artificial
  primer
atggctgaactcaatactcatg

SEQ ID NO: 139 - DNA, 20 bp, Artificial
  primer
ggccaccaacgtcacagccg

SEQ ID NO: 140 - DNA, 20 bp, Artificial
  primer
tcaggccaccaacgtcacag

SEQ ID NO: 141 - DNA, 20 bp, Artificial
  primer
atggatgccccgcgaaggga

SEQ ID NO: 142 - DNA, 22 bp, Artificial
  primer
gtaatagtgcatgcggcccagg

SEQ ID NO: 143 - DNA, 20 bp, Artificial
  primer
tcagtaatagtgcatgcggc

SEQ ID NO: 144 - DNA, 19 bp, Artificial
  primer
atggagccggactttctcc

SEQ ID NO: 145 - DNA, 20 bp, Artificial
  primer
ggacttcgaccccggggctc

SEQ ID NO: 146 - DNA, 19 bp, Artificial
  primer
tcaggacttcgaccccggg

SEQ ID NO: 147 - DNA, 4390 bp, Artificial
  vector pTrcHis TOPO
aagggcgaattcaattcgaagcttggctgttttggcggatgagagaagattttcagcctgatacagattaaatcagaacgcagaagcggtctgataaaacagaatttgcctggcggcagtagcgcggtggtcccacctgaccccatgccgaactcagaagtgaaacgccgtagcgccgatggtagtgtggggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacaaactcttttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtgttgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcctgatgcggtattttctccttacgcatctgtgcggtatttcacaccgcatatggtgcactctcagtacaatctgctctgatgccgcatagttaagccagtatacactccgctatcgctacgtgactgggtcatggctgcgccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgaggcagcagatcaattcgcgcgcgaaggcgaagcggcatgcatttacgttgacaccatcgaatggtgcaaaacctttcgcggtatggcatgatagcgcccggaagagagtcaattcagggtggtgaatgtgaaaccagtaacgttatacgatgtcgcagagtatgccggtgtctcttatcagaccgtttcccgcgtggtgaaccaggccagccacgtttctgcgaaaacgcgggaaaaagtggaagcggcgatggcggagctgaattacattcccaaccgcgtggcacaacaactggcgggcaaacagtcgttgctgattggcgttgccacctccagtctggccctgcacgcgccgtcgcaaattgtcgcggcgattaaatctcgcgccgatcaactgggtgccagcgtggtggtgtcgatggtagaacgaagcggcgtcgaagcctgtaaagcggcggtgcacaatcttctcgcgcaacgcgtcagtgggctgatcattaactatccgctggatgaccaggatgccattgctgtggaagctgcctgcactaatgttccggcgttatttcttgatgtctctgaccagacacccatcaacagtattattttctcccatgaagacggtacgcgactgggcgtggagcatctggtcgcattgggtcaccagcaaatcgcgctgttagcgggcccattaagttctgtctcggcgcgtctgcgtctggctggctggcataaatatctcactcgcaatcaaattcagccgatagcggaacgggaaggcgactggagtgccatgtccggttttcaacaaaccatgcaaatgctgaatgagggcatcgttcccactgcgatgctggttgccaacgatcagatggcgctgggcgcaatgcgcgccattaccgagtccgggctgcgcgttggtgcggatatctcggtagtgggatacgacgataccgaagacagctcatgttatatcccgccgttaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtaagttagcgcgaattgatctggtttgacagcttatcatcgactgcacggtgcaccaatgcttctggcgtcaggcagccatcggaagctgtggtatggctgtgcaggtcgtaaatcactgcataattcgtgtcgctcaaggcgcactcccgttctggataatgttttttgcgccgacatcataacggttctggcaaatattctgaaatgagctgttgacaattaatcatccggctcgtataatgtgtggaattgtgagcggataacaatttcacacaggaaacagcgccgctgagaaaaagcgaagcggcactgctctttaacaatttatcagacaatctgtgtgggcactcgaccggaattatcgattaactttattattaaaaattaaagaggtatatattaatgtatcgattaaataaggaggaataaaccatggggggttctcatcatcatcatcatcatggtatggctagcatgactggtggacagcaaatgggtcgggatctgtacgacgatgacgataaggatccaaccctt

SEQ ID NO: 148 - DNA, 2720 bp, Artificial
  vector pENTR4
ctttcctgcgttatcccctgattctgtggataaccgtattaccgctagcatggatctcggggacgtctaactactaagcgagagtagggaactgccaggcatcaaataaaacgaaaggctcagtcggaagactgggcctttcgttttatctgttgtttgtcggtgaacgctctcctgagtaggacaaatccgccgggagcggatttgaacgttgtgaagcaacggcccggagggtggcgggcaggacgcccgccataaactgccaggcatcaaactaagcagaaggccatcctgacggatggcctttttgcgtttctacaaactcttcctgttagttagttacttaagctcgggccccaaataatgattttattttgactgatagtgacctgttcgttgcaacaaattgataagcaatgcttttttataatgccaactttgtacaaaaaagcaggctccaccatgggaaccaattcagtcgactggatccggtaccgaattcgcttactaaaagccagataacagtatgcgtatttgcgcgctgatttttgcggtataagaatatatactgatatgtatacccgaagtatgtcaaaaagaggtgtgcttctagaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatatagaattcgcggccgcactcgagatatctagacccagctttcttgtacaaagttggcattataagaaagcattgcttatcaatttgttgcaacgaacaggtcactatcagtcaaaataaaatcattatttgccatccagctgcagctctggcccgtgtctcaaaatctctgatgttacattgcacaagataaaaatatatcatcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctggtgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacattattcagattgggccccgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgtt

SEQ ID NO: 149 - DNA, 3441 bp, Artificial
  vector pENTR4 eGFP
gatatctagacccagctttcttgtacaaagttggcattataagaaagcattgcttatcaatttgttgcaacgaacaggtcactatcagtcaaaataaaatcattatttgccatccagctgcagctctggcccgtgtctcaaaatctctgatgttacattgcacaagataaaaatatatcatcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctggtgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacattattcagattgggccccgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgctagcatggatctcggggacgtctaactactaagcgagagtagggaactgccaggcatcaaataaaacgaaaggctcagtcggaagactgggcctttcgttttatctgttgtttgtcggtgaacgctctcctgagtaggacaaatccgccgggagcggatttgaacgttgtgaagcaacggcccggagggtggcgggcaggacgcccgccataaactgccaggcatcaaactaagcagaaggccatcctgacggatggcctttttgcgtttctacaaactcttcctgttagttagttacttaagctcgggccccaaataatgattttattttgactgatagtgacctgttcgttgcaacaaattgataagcaatgcttttttataatgccaactttgtacaaaaaagcaggctccaccatgggaaccaattcagtcgactggatccggtaccgaattcgcttactaaaagccagataacagtatgcgtatttgcgcgctgatttttgcggtataagaatatatactgatatgtatacccgaagtatgtcaaaaagaggtgtgcttctagaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatatagaattcgcggccgctgcagcagcagtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagtaa

SEQ ID NO: 150 - DNA, 8688 bp, Artificial
  vector pLenti 6_V5-DEST
aatgtagtcttatgcaatactcttgtagtcttgcaacatggtaacgatgagttagcaacatgccttacaaggagagaaaaagcaccgtgcatgccgattggtggaagtaaggtggtacgatcgtgccttattaggaaggcaacagacgggtctgacatggattggacgaaccactgaattgccgcattgcagagatattgtatttaagtgcctagctcgatacataaacgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaagagcaaaacaaaagtaagaccaccgcacagcaagcggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgataagcttgggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgactctagaggatccactagtccagtgtggtggaattctgcagatatcaacaagtttgtacaaaaaagctgaacgagaaacgtaaaatgatataaatatcaatatattaaattagattttgcataaaaaacagactacataatactgtaaaacacaacatatccagtcactatggcggccgcattaggcaccccaggctttacactttatgcttccggctcgtataatgtgtggattttgagttaggatccggcgagattttcaggagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtctgtgatggcttccatgtcggcagaatgcttaatgaattacaacagtactgcgatgagtggcagggcggggcgtaaagatctggatccggcttactaaaagccagataacagtatgcgtatttgcgcgctgatttttgcggtataagaatatatactgatatgtatacccgaagtatgtcaaaaagaggtgtgctatgaagcagcgtattacagtgacagttgacagcgacagctatcagttgctcaaggcatatatgatgtcaatatctccggtctggtaagcacaaccatgcagaatgaagcccgtcgtctgcgtgccgaacgctggaaagcggaaaatcaggaagggatggctgaggtcgcccggtttattgaaatgaacggctcttttgctgacgagaacagggactggtgaaatgcagtttaaggtttacacctataaaagagagagccgttatcgtctgtttgtggatgtacagagtgatattattgacacgcccgggcgacggatggtgatccccctggccagtgcacgtctgctgtcagataaagtctcccgtgaactttacccggtggtgcatatcggggatgaaagctggcgcatgatgaccaccgatatggccagtgtgccggtctccgttatcggggaagaagtggctgatctcagccaccgcgaaaatgacatcaaaaacgccattaacctgatgttctggggaatataaatgtcaggctccgttatacacagccagtctgcaggtcgaccatagtgactggatatgttgtgttttacagtattatgtagtctgttttttatgcaaaatctaatttaatatattgatatttatatcattttacgtttctcgttcagctttcttgtacaaagtggttgatatccagcacagtggcggccgctcgagtctagagggcccgcggttcgaaggtaagcctatccctaaccctctcctcggtctcgattctacgcgtaccggttagtaatgagtttggaattaattctgtggaatgtgtgtcagttagggtgtggaaagtccccaggctccccaggcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcagcacgtgttgacaattaatcatcggcatagtatatcggcatagtataatacgacaaggtgaggaactaaaccatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctaagcacaattcgagctcggtacctttaagaccaatgacttacaaggcagctgtagatcttagccactttttaaaagaaaaggggggactggaagggctaattcactcccaacgaagacaagatctgctttttgcttgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtagtagttcatgtcatcttattattcagtatttataacttgcaaagaaatgaatatcagagagtgagaggaacttgtttattgcagcttataatggttacaaataaagcaatagcatcacaaatttcacaaataaagcatttttttcactgcattctagttgtggtttgtccaaactcatcaatgtatcttatcatgtctggctctagctatcccgcccctaactccgcccatcccgcccctaactccgcccagttccgcccattctccgccccatggctgactaattttttttatttatgcagaggccgaggccgcctcggcctctgagctattccagaagtagtgaggaggcttttttggaggcctagggacgtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgcttacaatttaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgccaagcgcgcaattaaccctcactaaagggaacaaaagctggagctgcaagctt

SEQ ID NO: 151 - DNA, 5144 bp, Artificial
  vector pcDNA-V5-His
gacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgcgatgtacgggccagatatacgcgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagctggctagcgtttaaacttaagcttggtaccgagctcggatccactagtccagtgtggtggaattctgcagatatccagcacagtggcggccgctcgagtctagagggcccttcgaaggtaagcctatccctaaccctctcctcggtctcgattctacgcgtaccggtcatcatcaccatcaccattgagtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcagcacgtgttgacaattaatcatcggcatagtatatcggcatagtataatacgacaaggtgaggaactaaaccatggccaagcctttgtctcaagaagaatccaccctcattgaaagagcaacggctacaatcaacagcatccccatctctgaagactacagcgtcgccagcgcagctctctctagcgacggccgcatcttcactggtgtcaatgtatatcattttactgggggaccttgtgcagaactcgtggtgctgggcactgctgctgctgcggcagctggcaacctgacttgtatcgtcgcgatcggaaatgagaacaggggcatcttgagcccctgcggacggtgccgacaggtgcttctcgatctgcatcctgggatcaaagccatagtgaaggacagtgatggacagccgacggcagttgggattcgtgaattgctgccctctggttatgtgtgggagggctaagcacttcgtggccgaggagcaggactgacacgtgctacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacgtc

SEQ ID NO: 152 - protein, 9 aa, Homo sapiens
EEDPKMHTY

SEQ ID NO: 153 - protein, 9 aa, Homo sapiens
VTHHSIELY

SEQ ID NO: 154 - protein, 9 aa, Homo sapiens
TSPSGECEY

SEQ ID NO: 155 - protein, 9 aa, Homo sapiens
AGHLDVVKY

SEQ ID NO: 156 - protein, 9 aa, Homo sapiens
EGLEPRTLY

SEQ ID NO: 157 - protein, 9 aa, Homo sapiens
LMVAAQKGY

SEQ ID NO: 158 - protein, 9 aa, Homo sapiens
GTDVNLKNG

SEQ ID NO: 159 - protein, 9 aa, Homo sapiens
ILQGGRVKV

SEQ ID NO: 160 - protein, 9 aa, Homo sapiens
LLIDAGANV

SEQ ID NO: 161 - protein, 9 aa, Homo sapiens
TLYRFRLKV

SEQ ID NO: 162 - protein, 9 aa, Homo sapiens
MLACYAGHL

SEQ ID NO: 163 - protein, 9 aa, Homo sapiens
ILVSNGTDV

SEQ ID NO: 164 - protein, 9 aa, Homo sapiens
AADGGHCSV

SEQ ID NO: 165 - protein, 9 aa, Homo sapiens
WMIKDGCEV

SEQ ID NO: 166 - protein, 9 aa, Homo sapiens
VLNNHEELV

SEQ ID NO: 167 - protein, 9 aa, Homo sapiens
LLLDKGADA

SEQ ID NO: 168 - protein, 9 aa, Homo sapiens
SGNQRVASL

SEQ ID NO: 169 - protein, 9 aa, Homo sapiens
KTPLMVAVL

SEQ ID NO: 170 - protein, 9 aa, Homo sapiens
ATKHVVEGL

SEQ ID NO: 171 - protein, 9 aa, Homo sapiens
CEYSPLVSV

SEQ ID NO: 172 - protein, 9 aa, Homo sapiens
AVLNNHEEL

SEQ ID NO: 173 - protein, 9 aa, Homo sapiens
SVNDEDLLV

SEQ ID NO: 174 - protein, 9 aa, Homo sapiens
FDRQSVVSL

SEQ ID NO: 175 - protein, 9 aa, Homo sapiens
SIEEEDPKM

SEQ ID NO: 176 - protein, 9 aa, Homo sapiens
AAQKGYTRL

SEQ ID NO: 177 - protein, 9 aa, Homo sapiens
KGYTRLVKI

SEQ ID NO: 178 - protein, 9 aa, Homo sapiens
RLVKILVSN

SEQ ID NO: 179 - protein, 9 aa, Homo sapiens
CYAGHLDVV

SEQ ID NO: 180 - protein, 9 aa, Homo sapiens
SGWTPLMRV

SEQ ID NO: 181 - protein, 9 aa, Homo sapiens
SAVSGNQRV

SEQ ID NO: 182 - protein, 9 aa, Homo sapiens
IDAGANVNV

SEQ ID NO: 183 - protein, 9 aa, Homo sapiens
NNHEELVQL

SEQ ID NO: 184 - protein, 9 aa, Homo sapiens
IIYTGYATK

SEQ ID NO: 185 - protein, 9 aa, Homo sapiens
LLVRILQGG

SEQ ID NO: 186 - protein, 9 aa, Homo sapiens
GHLDVVKYL

SEQ ID NO: 187 - protein, 9 aa, Homo sapiens
RDLGGCTAL

SEQ ID NO: 188 - protein, 9 aa, Homo sapiens
TPLMRVSAV

SEQ ID NO: 189 - protein, 9 aa, Homo sapiens
LDKGADASV

SEQ ID NO: 190 - protein, 9 aa, Homo sapiens
SLLEERKKK

SEQ ID NO: 191 - protein, 9 aa, Homo sapiens
KVTHHSIEL

SEQ ID NO: 192 - protein, 9 aa, Homo sapiens
GIIYTGYAT

SEQ ID NO: 193 - protein, 9 aa, Homo sapiens
YTGYATKHV

SEQ ID NO: 194 - protein, 9 aa, Homo sapiens
AVSVNDEDL

SEQ ID NO: 195 - protein, 9 aa, Homo sapiens
DLLVRILQG

SEQ ID NO: 196 - protein, 9 aa, Homo sapiens
AQKGYTRLV

SEQ ID NO: 197 - protein, 9 aa, Homo sapiens
YTRLVKILV

SEQ ID NO: 198 - protein, 9 aa, Homo sapiens
VSNGTDVNL

SEQ ID NO: 199 - protein, 9 aa, Homo sapiens
ACYAGHLDV

SEQ ID NO: 200 - protein, 9 aa, Homo sapiens
YLRRHGASW

SEQ ID NO: 201 - protein, 9 aa, Homo sapiens
IKDGCEVDV

SEQ ID NO: 202 - protein, 9 aa, Homo sapiens
GKTPLMVAV

SEQ ID NO: 203 - protein, 9 aa, Homo sapiens
NHEELVQLL

SEQ ID NO: 204 - protein, 9 aa, Homo sapiens
RVFDRQSVV

SEQ ID NO: 205 - protein, 9 aa, Homo sapiens
IIYTGYATK

SEQ ID NO: 206 - protein, 9 aa, Homo sapiens
RILQGGRVK

SEQ ID NO: 207 - protein, 9 aa, Homo sapiens
RVKVDVPNK

SEQ ID NO: 208 - protein, 9 aa, Homo sapiens
SLLEERKKK

SEQ ID NO: 209 - protein, 9 aa, Homo sapiens
ELYWDLEKK

SEQ ID NO: 210 - protein, 9 aa, Homo sapiens
YLRRHGASW

SEQ ID NO: 211 - protein, 9 aa, Homo sapiens
GVLEMARVF

SEQ ID NO: 212 - protein, 9 aa, Homo sapiens
RVFDRQSVV

SEQ ID NO: 213 - protein, 9 aa, Homo sapiens
ELVQLLLDK

SEQ ID NO: 214 - protein, 9 aa, Homo sapiens
GLEPRTLYR

SEQ ID NO: 215 - protein, 9 aa, Homo sapiens
TALMVAAQK

SEQ ID NO: 216 - protein, 9 aa, Homo sapiens
DKGADASVK

SEQ ID NO: 217 - protein, 9 aa, Homo sapiens
TLYRFRLKV

SEQ ID NO: 218 - protein, 9 aa, Homo sapiens
ILQGGRVKV

SEQ ID NO: 219 - protein, 9 aa, Homo sapiens
PLMRVSAVS

SEQ ID NO: 220 - protein, 9 aa, Homo sapiens
VVSLLEERK

SEQ ID NO: 221 - protein, 9 aa, Homo sapiens
KPHPPVVGK

SEQ ID NO: 222 - protein, 9 aa, Homo sapiens
PLVSVSTTR

SEQ ID NO: 223 - protein, 9 aa, Homo sapiens
HLHRAVSVN

SEQ ID NO: 224 - protein, 9 aa, Homo sapiens
DLLVRILQG

SEQ ID NO: 225 - protein, 9 aa, Homo sapiens
QKGYTRLVK

SEQ ID NO: 226 - protein, 9 aa, Homo sapiens
RLVKILVSN

SEQ ID NO: 227 - protein, 9 aa, Homo sapiens
LLIDAGANV

SEQ ID NO: 228 - protein, 9 aa, Homo sapiens
LLLDKGADA

SEQ ID NO: 229 - protein, 9 aa, Homo sapiens
RIMPPSKPH

SEQ ID NO: 230 - protein, 9 aa, Homo sapiens
LVRILQGGR

SEQ ID NO: 231 - protein, 9 aa, Homo sapiens
DLGGCTALH

SEQ ID NO: 232 - protein, 9 aa, Homo sapiens
AVSGNQRVA

SEQ ID NO: 233 - protein, 9 aa, Homo sapiens
SLLIDAGAN

SEQ ID NO: 234 - protein, 9 aa, Homo sapiens
LIDAGANVN

SEQ ID NO: 235 - protein, 9 aa, Homo sapiens
PVVGKVTHH

SEQ ID NO: 236 - protein, 9 aa, Homo sapiens
RTLYRFRLK

SEQ ID NO: 237 - protein, 9 aa, Homo sapiens
KILVSNGTD

SEQ ID NO: 238 - protein, 9 aa, Homo sapiens
VNLKNGSGK

SEQ ID NO: 239 - protein, 9 aa, Homo sapiens
YAGHLDVVK

SEQ ID NO: 240 - protein, 9 aa, Homo sapiens
RVSAVSGNQ

SEQ ID NO: 241 - protein, 9 aa, Homo sapiens
PQRIMPPSK

SEQ ID NO: 242 - protein, 9 aa, Homo sapiens
IELYWDLEK

SEQ ID NO: 243 - protein, 9 aa, Homo sapiens
HVVEGLEPR

SEQ ID NO: 244 - protein, 9 aa, Homo sapiens
RLKVTSPSG

SEQ ID NO: 245 - protein, 9 aa, Homo sapiens
LVSNGTDVN

SEQ ID NO: 246 - protein, 9 aa, Homo sapiens
DVVDTGSGW

SEQ ID NO: 247 - protein, 9 aa, Homo sapiens
QLLLDKGAD

SEQ ID NO: 248 - protein, 9 aa, Homo sapiens
ALMVAAQKG

SEQ ID NO: 249 - protein, 9 aa, Homo sapiens
ILVSNGTDV

SEQ ID NO: 250 - protein, 9 aa, Homo sapiens
ALHWAADGG

SEQ ID NO: 251 - protein, 9 aa, Homo sapiens
MIKDGCEVD

SEQ ID NO: 252 - protein, 9 aa, Homo sapiens
DAGANVNVK

SEQ ID NO: 253 - protein, 9 aa, Homo sapiens
AVLNNHEEL

SEQ ID NO: 254 - protein, 9 aa, Homo sapiens
LLDKGADAS

SEQ ID NO: 255 - protein, 8 aa, Homo sapiens
RKKKQRPK

SEQ ID NO: 256 - protein, 9 aa, Homo sapiens
LTKEATSVY

SEQ ID NO: 257 - protein, 9 aa, Homo sapiens
SSAVFGVKY

SEQ ID NO: 258 - protein, 9 aa, Homo sapiens
ESSFWLPLY

SEQ ID NO: 259 - protein, 9 aa, Homo sapiens
NTDQLVKDN

SEQ ID NO: 260 - protein, 9 aa, Homo sapiens
ITDICFENV

SEQ ID NO: 261 - protein, 9 aa, Homo sapiens
GLISWRRLY

SEQ ID NO: 262 - protein, 9 aa, Homo sapiens
LTDIIQKKI

SEQ ID NO: 263 - protein, 9 aa, Homo sapiens
TSELQKLEE

SEQ ID NO: 264 - protein, 9 aa, Homo sapiens
SNKERSRRY

SEQ ID NO: 265 - protein, 9 aa, Homo sapiens
DFQIKVEVY

SEQ ID NO: 266 - protein, 9 aa, Homo sapiens
CVLRGGKLY

SEQ ID NO: 267 - protein, 9 aa, Homo sapiens
MVIQKKVLY

SEQ ID NO: 268 - protein, 9 aa, Homo sapiens
VCNARLMAY

SEQ ID NO: 269 - protein, 9 aa, Homo sapiens
DTDVVNVDK

SEQ ID NO: 270 - protein, 9 aa, Homo sapiens
RGGKLYCFY

SEQ ID NO: 271 - protein, 9 aa, Homo sapiens
ASEPLHDEK

SEQ ID NO: 272 - protein, 9 aa, Homo sapiens
HTDTKTNFE

SEQ ID NO: 273 - protein, 9 aa, Homo sapiens
LLAHTTLTL

SEQ ID NO: 274 - protein, 9 aa, Homo sapiens
SLPPPWATL

SEQ ID NO: 275 - protein, 9 aa, Homo sapiens
SLDTKLSTL

SEQ ID NO: 276 - protein, 9 aa, Homo sapiens
RMREGIWKL

SEQ ID NO: 277 - protein, 9 aa, Homo sapiens
LLSSAVFGV

SEQ ID NO: 278 - protein, 9 aa, Homo sapiens
SLRGPALRL

SEQ ID NO: 279 - protein, 9 aa, Homo sapiens
RLMAYTSEL

SEQ ID NO: 280 - protein, 9 aa, Homo sapiens
VLYPASEPL

SEQ ID NO: 281 - protein, 9 aa, Homo sapiens
NLMVCNARL

SEQ ID NO: 282 - protein, 9 aa, Homo sapiens
CLFKMGANV

SEQ ID NO: 283 - protein, 9 aa, Homo sapiens
ATGKKISSV

SEQ ID NO: 284 - protein, 9 aa, Homo sapiens
IMSPRKPPL

SEQ ID NO: 285 - protein, 9 aa, Homo sapiens
KLSTLMHHL

SEQ ID NO: 286 - protein, 9 aa, Homo sapiens
LLPARRNRL

SEQ ID NO: 287 - protein, 9 aa, Homo sapiens
SLSTQKDQV

SEQ ID NO: 288 - protein, 9 aa, Homo sapiens
FLTKEATSV

SEQ ID NO: 289 - protein, 9 aa, Homo sapiens
LIGQHEESL

SEQ ID NO: 290 - protein, 9 aa, Homo sapiens
AISDIRIPL

SEQ ID NO: 291 - protein, 9 aa, Homo sapiens
QAITQIFAV

SEQ ID NO: 292 - protein, 9 aa, Homo sapiens
KLESLTDII

SEQ ID NO: 293 - protein, 9 aa, Homo sapiens
IIQKKIEET

SEQ ID NO: 294 - protein, 9 aa, Homo sapiens
DILDPRSWL

SEQ ID NO: 295 - protein, 9 aa, Homo sapiens
GPALRLAGL

SEQ ID NO: 296 - protein, 9 aa, Homo sapiens
SITNTPKKL

SEQ ID NO: 297 - protein, 9 aa, Homo sapiens
KLKTSISKA

SEQ ID NO: 298 - protein, 9 aa, Homo sapiens
AVFGVKYNL

SEQ ID NO: 299 - protein, 9 aa, Homo sapiens
ALVVPINKE

SEQ ID NO: 300 - protein, 9 aa, Homo sapiens
QVLHAVKNL

SEQ ID NO: 301 - protein, 9 aa, Homo sapiens
KIAISDIRI

SEQ ID NO: 302 - protein, 9 aa, Homo sapiens
KLAKKLKTS

SEQ ID NO: 303 - protein, 9 aa, Homo sapiens
VLQEEDDEM

SEQ ID NO: 304 - protein, 9 aa, Homo sapiens
TLFDGNHQM

SEQ ID NO: 305 - protein, 9 aa, Homo sapiens
APLPPSDKL

SEQ ID NO: 306 - protein, 9 aa, Homo sapiens
KLEEQIANQ

SEQ ID NO: 307 - protein, 9 aa, Homo sapiens
DICFENVTI

SEQ ID NO: 308 - protein, 9 aa, Homo sapiens
NLLAHTTLT

SEQ ID NO: 309 - protein, 9 aa, Homo sapiens
QMVEGLISW

SEQ ID NO: 310 - protein, 9 aa, Homo sapiens
ISWRRLYCV

SEQ ID NO: 311 - protein, 9 aa, Homo sapiens
SLTDIIQKK

SEQ ID NO: 312 - protein, 9 aa, Homo sapiens
ALRLAGLPT

SEQ ID NO: 313 - protein, 9 aa, Homo sapiens
EGIWKLLSL

SEQ ID NO: 314 - protein, 9 aa, Homo sapiens
AYTSELQKL

SEQ ID NO: 315 - protein, 9 aa, Homo sapiens
YAIFCLFKM

SEQ ID NO: 316 - protein, 9 aa, Homo sapiens
KMGANVFDT

SEQ ID NO: 317 - protein, 9 aa, Homo sapiens
GANVFDTDV

SEQ ID NO: 318 - protein, 9 aa, Homo sapiens
VFDTDVVNV

SEQ ID NO: 319 - protein, 9 aa, Homo sapiens
SPEEIEAKV

SEQ ID NO: 320 - protein, 9 aa, Homo sapiens
FLIGQHEES

SEQ ID NO: 321 - protein, 9 aa, Homo sapiens
QMVIQKKVL

SEQ ID NO: 322 - protein, 9 aa, Homo sapiens
QTSSLDTKL

SEQ ID NO: 323 - protein, 9 aa, Homo sapiens
TLMHHLQKP

SEQ ID NO: 324 - protein, 9 aa, Homo sapiens
PMAAPRKLL

SEQ ID NO: 325 - protein, 9 aa, Homo sapiens
LLSLSTQKD

SEQ ID NO: 326 - protein, 9 aa, Homo sapiens
QKDQVLHAV

SEQ ID NO: 327 - protein, 9 aa, Homo sapiens
VLHAVKNLM

SEQ ID NO: 328 - protein, 9 aa, Homo sapiens
LHAVKNLMV

SEQ ID NO: 329 - protein, 9 aa, Homo sapiens
ELQKLEEQI

SEQ ID NO: 330 - protein, 9 aa, Homo sapiens
NVDKTITDI

SEQ ID NO: 331 - protein, 9 aa, Homo sapiens
ITDICFENV

SEQ ID NO: 332 - protein, 9 aa, Homo sapiens
AGPDFQIKV

SEQ ID NO: 333 - protein, 9 aa, Homo sapiens
LAKKLKTSI

SEQ ID NO: 334 - protein, 9 aa, Homo sapiens
EMCLLLSSA

SEQ ID NO: 335 - protein, 9 aa, Homo sapiens
LLLSSAVFG

SEQ ID NO: 336 - protein, 9 aa, Homo sapiens
YNLLAHTTL

SEQ ID NO: 337 - protein, 9 aa, Homo sapiens
RLVAQPACM

SEQ ID NO: 338 - protein, 9 aa, Homo sapiens
RLYCVLRGG

SEQ ID NO: 339 - protein, 9 aa, Homo sapiens
VLRGGKLYC

SEQ ID NO: 340 - protein, 9 aa, Homo sapiens
IEAKVEPAL

SEQ ID NO: 341 - protein, 9 aa, Homo sapiens
AKVEPALVV

SEQ ID NO: 342 - protein, 9 aa, Homo sapiens
VEPALVVPI

SEQ ID NO: 343 - protein, 9 aa, Homo sapiens
HNFSVINPV

SEQ ID NO: 344 - protein, 9 aa, Homo sapiens
VINPVPGQA

SEQ ID NO: 345 - protein, 9 aa, Homo sapiens
FAVDNREDL

SEQ ID NO: 346 - protein, 9 aa, Homo sapiens
HCCEELMKI

SEQ ID NO: 347 - protein, 9 aa, Homo sapiens
DSPMKLESL

SEQ ID NO: 348 - protein, 9 aa, Homo sapiens
MKLESLTDI

SEQ ID NO: 349 - protein, 9 aa, Homo sapiens
KDNWGKTSV

SEQ ID NO: 350 - protein, 9 aa, Homo sapiens
AAPRKLLPA

SEQ ID NO: 351 - protein, 9 aa, Homo sapiens
RLSDGEHTD

SEQ ID NO: 352 - protein, 9 aa, Homo sapiens
KLLSLSTQK

SEQ ID NO: 353 - protein, 9 aa, Homo sapiens
CVLRGGKLY

SEQ ID NO: 354 - protein, 9 aa, Homo sapiens
DIRIPLMWK

SEQ ID NO: 355 - protein, 9 aa, Homo sapiens
CLLLSSAVF

SEQ ID NO: 356 - protein, 9 aa, Homo sapiens
KVEPALVVP

SEQ ID NO: 357 - protein, 9 aa, Homo sapiens
RKPPLFLTK

SEQ ID NO: 358 - protein, 9 aa, Homo sapiens
MVIQKKVLY

SEQ ID NO: 359 - protein, 9 aa, Homo sapiens
ALRLAGLPT

SEQ ID NO: 360 - protein, 9 aa, Homo sapiens
KLLPARRNR

SEQ ID NO: 361 - protein, 9 aa, Homo sapiens
SLRGPALRL

SEQ ID NO: 362 - protein, 9 aa, Homo sapiens
RLAGLPTQQ

SEQ ID NO: 363 - protein, 9 aa, Homo sapiens
KIEIMSPRK

SEQ ID NO: 364 - protein, 9 aa, Homo sapiens
SLTDIIQKK

SEQ ID NO: 365 - protein, 9 aa, Homo sapiens
PLHDEKGKK

SEQ ID NO: 366 - protein, 9 aa, Homo sapiens
QLVKDNWGK

SEQ ID NO: 367 - protein, 9 aa, Homo sapiens
SLPPPWATL

SEQ ID NO: 368 - protein, 9 aa, Homo sapiens
KVLYPASEP

SEQ ID NO: 369 - protein, 9 aa, Homo sapiens
RLSDGEHTD

SEQ ID NO: 370 - protein, 9 aa, Homo sapiens
KDQVLHAVK

SEQ ID NO: 371 - protein, 9 aa, Homo sapiens
MAYTSELQK

SEQ ID NO: 372 - protein, 9 aa, Homo sapiens
SISKATGKK

SEQ ID NO: 373 - protein, 9 aa, Homo sapiens
PLYGNMCCR

SEQ ID NO: 374 - protein, 9 aa, Homo sapiens
RLVAQPACM

SEQ ID NO: 375 - protein, 9 aa, Homo sapiens
MVEGLISWR

SEQ ID NO: 376 - protein, 9 aa, Homo sapiens
GLISWRRLY

SEQ ID NO: 377 - protein, 9 aa, Homo sapiens
VLRGGKLYC

SEQ ID NO: 378 - protein, 9 aa, Homo sapiens
KLYCFYSPE

SEQ ID NO: 379 - protein, 9 aa, Homo sapiens
ETRIRAMDK

SEQ ID NO: 380 - protein, 9 aa, Homo sapiens
KIEETNGQF

SEQ ID NO: 381 - protein, 9 aa, Homo sapiens
KPVPAPRQK

SEQ ID NO: 382 - protein, 9 aa, Homo sapiens
IRMREGIWK

SEQ ID NO: 383 - protein, 9 aa, Homo sapiens
AVKNLMVCN

SEQ ID NO: 384 - protein, 9 aa, Homo sapiens
RLMAYTSEL

SEQ ID NO: 385 - protein, 9 aa, Homo sapiens
RYAIFCLFK

SEQ ID NO: 386 - protein, 9 aa, Homo sapiens
NVFDTDVVN

SEQ ID NO: 387 - protein, 9 aa, Homo sapiens
KLAKKLKTS

SEQ ID NO: 388 - protein, 9 aa, Homo sapiens
LLLSSAVFG

SEQ ID NO: 389 - protein, 9 aa, Homo sapiens
GVKYNLLAH

SEQ ID NO: 390 - protein, 9 aa, Homo sapiens
RLYCVLRGG

SEQ ID NO: 391 - protein, 9 aa, Homo sapiens
VVPINKETR

SEQ ID NO: 392 - protein, 9 aa, Homo sapiens
RAMDKDAKK

SEQ ID NO: 393 - protein, 9 aa, Homo sapiens
PVPGQAITQ

SEQ ID NO: 394 - protein, 9 aa, Homo sapiens
VDNREDLQK

SEQ ID NO: 395 - protein, 9 aa, Homo sapiens
QSNTDQLVK

SEQ ID NO: 396 - protein, 9 aa, Homo sapiens
SLDTKLSTL

SEQ ID NO: 397 - protein, 9 aa, Homo sapiens
STLMHHLQK

SEQ ID NO: 398 - protein, 9 aa, Homo sapiens
NQTGRCDVK

SEQ ID NO: 399 - protein, 9 aa, Homo sapiens
PLMWKDSDH

SEQ ID NO: 400 - protein, 9 aa, Homo sapiens
TNTPKKLAK

SEQ ID NO: 401 - protein, 9 aa, Homo sapiens
TSISKATGK

SEQ ID NO: 402 - protein, 9 aa, Homo sapiens
LSSAVFGVK

SEQ ID NO: 403 - protein, 9 aa, Homo sapiens
LLAHTTLTL

SEQ ID NO: 404 - protein, 9 aa, Homo sapiens
AITQIFAVD

SEQ ID NO: 405 - protein, 9 aa, Homo sapiens
SVYHDMSID

SEQ ID NO: 406 - protein, 9 aa, Homo sapiens
KIDLEIRMR

SEQ ID NO: 407 - protein, 9 aa, Homo sapiens
KLEEQIANQ

SEQ ID NO: 408 - protein, 9 aa, Homo sapiens
RCDVKFESK

SEQ ID NO: 409 - protein, 9 aa, Homo sapiens
ESKERTACK

SEQ ID NO: 410 - protein, 9 aa, Homo sapiens
KDSDHFSNK

SEQ ID NO: 411 - protein, 9 aa, Homo sapiens
KKLKTSISK

SEQ ID NO: 412 - protein, 9 aa, Homo sapiens
KLKTSISKA

SEQ ID NO: 413 - protein, 9 aa, Homo sapiens
RIRAMDKDA

SEQ ID NO: 414 - protein, 9 aa, Homo sapiens
RIHNFSVIN

SEQ ID NO: 415 - protein, 9 aa, Homo sapiens
VINPVPGQA

SEQ ID NO: 416 - protein, 9 aa, Homo sapiens
KHCCEELMK

SEQ ID NO: 417 - protein, 9 aa, Homo sapiens
VLYPASEPL

SEQ ID NO: 418 - protein, 9 aa, Homo sapiens
QAPLPPSDK

SEQ ID NO: 419 - protein, 9 aa, Homo sapiens
ILDPRSWLQ

SEQ ID NO: 420 - protein, 9 aa, Homo sapiens
MVCNARLMA

SEQ ID NO: 421 - protein, 9 aa, Homo sapiens
KERTACKGK

SEQ ID NO: 422 - protein, 9 aa, Homo sapiens
CLFKMGANV

SEQ ID NO: 423 - protein, 9 aa, Homo sapiens
DVVNVDKTI

SEQ ID NO: 424 - protein, 9 aa, Homo sapiens
DICFENVTI

SEQ ID NO: 425 - protein, 9 aa, Homo sapiens
AVFGVKYNL

SEQ ID NO: 426 - protein, 9 aa, Homo sapiens
TLESAEDSF

SEQ ID NO: 427 - protein, 9 aa, Homo sapiens
AVDNREDLQ

SEQ ID NO: 428 - protein, 9 aa, Homo sapiens
FLTKEATSV

SEQ ID NO: 429 - protein, 9 aa, Homo sapiens
TLFDGNHQM

SEQ ID NO: 430 - protein, 9 aa, Homo sapiens
ASEPLHDEK

SEQ ID NO: 431 - protein, 9 aa, Homo sapiens
SDKLPFSLK

SEQ ID NO: 432 - protein, 9 aa, Homo sapiens
SLKSQSNTD

SEQ ID NO: 433 - protein, 9 aa, Homo sapiens
SDGEHTDTK

SEQ ID NO: 434 - protein, 9 aa, Homo sapiens
PAPRQKSIK

SEQ ID NO: 435 - protein, 9 aa, Homo sapiens
DILDPRSWL

SEQ ID NO: 436 - protein, 9 aa, Homo sapiens
EKEENMGQY

SEQ ID NO: 437 - protein, 9 aa, Homo sapiens
SGTYLGLDY

SEQ ID NO: 438 - protein, 9 aa, Homo sapiens
SKGIHFQDY

SEQ ID NO: 439 - protein, 9 aa, Homo sapiens
VADQQQLRD

SEQ ID NO: 440 - protein, 9 aa, Homo sapiens
MPVAQQPVY

SEQ ID NO: 441 - protein, 9 aa, Homo sapiens
ENMGQYIEY

SEQ ID NO: 442 - protein, 9 aa, Homo sapiens
LVSVISGTY

SEQ ID NO: 443 - protein, 9 aa, Homo sapiens
DHIKDMIKY

SEQ ID NO: 444 - protein, 9 aa, Homo sapiens
LIANGLITL

SEQ ID NO: 445 - protein, 9 aa, Homo sapiens
ALLLKGAKV

SEQ ID NO: 446 - protein, 9 aa, Homo sapiens
ALNGAIMKI

SEQ ID NO: 447 - protein, 9 aa, Homo sapiens
TLQINLVSV

SEQ ID NO: 448 - protein, 9 aa, Homo sapiens
LLKGAKVAL

SEQ ID NO: 449 - protein, 9 aa, Homo sapiens
HVNGKVALV

SEQ ID NO: 450 - protein, 9 aa, Homo sapiens
QLRDTFRKV

SEQ ID NO: 451 - protein, 9 aa, Homo sapiens
VISGTYLGL

SEQ ID NO: 452 - protein, 9 aa, Homo sapiens
GIIINMSSL

SEQ ID NO: 453 - protein, 9 aa, Homo sapiens
NLMNSGVRL

SEQ ID NO: 454 - protein, 9 aa, Homo sapiens
DILVNNAGV

SEQ ID NO: 455 - protein, 9 aa, Homo sapiens
SLAGLMPVA

SEQ ID NO: 456 - protein, 9 aa, Homo sapiens
IANGLITLI

SEQ ID NO: 457 - protein, 9 aa, Homo sapiens
ALVDWNLEA

SEQ ID NO: 458 - protein, 9 aa, Homo sapiens
RLDILVNNA

SEQ ID NO: 459 - protein, 9 aa, Homo sapiens
INMSSLAGL

SEQ ID NO: 460 - protein, 9 aa, Homo sapiens
SSLAGLMPV

SEQ ID NO: 461 - protein, 9 aa, Homo sapiens
LMPVAQQPV

SEQ ID NO: 462 - protein, 9 aa, Homo sapiens
GIVGFTRSA

SEQ ID NO: 463 - protein, 9 aa, Homo sapiens
AICPGFVNT

SEQ ID NO: 464 - protein, 9 aa, Homo sapiens
AILESIEKE

SEQ ID NO: 465 - protein, 9 aa, Homo sapiens
DMIKYYGIL

SEQ ID NO: 466 - protein, 9 aa, Homo sapiens
ILDPPLIAN

SEQ ID NO: 467 - protein, 9 aa, Homo sapiens
LLLKGAKVA

SEQ ID NO: 468 - protein, 9 aa, Homo sapiens
LKGAKVALV

SEQ ID NO: 469 - protein, 9 aa, Homo sapiens
NLVSVISGT

SEQ ID NO: 470 - protein, 9 aa, Homo sapiens
ITLIEDDAL

SEQ ID NO: 471 - protein, 9 aa, Homo sapiens
ALAANLMNS

SEQ ID NO: 472 - protein, 9 aa, Homo sapiens
AANLMNSGV

SEQ ID NO: 473 - protein, 9 aa, Homo sapiens
GILDPPLIA

SEQ ID NO: 474 - protein, 9 aa, Homo sapiens
GLITLIEDD

SEQ ID NO: 475 - protein, 9 aa, Homo sapiens
GAAQGIGRA

SEQ ID NO: 476 - protein, 9 aa, Homo sapiens
GIGRAFAEA

SEQ ID NO: 477 - protein, 9 aa, Homo sapiens
KVALVDWNL

SEQ ID NO: 478 - protein, 9 aa, Homo sapiens
LQINLVSVI

SEQ ID NO: 479 - protein, 9 aa, Homo sapiens
LMNSGVRLN

SEQ ID NO: 480 - protein, 9 aa, Homo sapiens
ALVTGAAQG

SEQ ID NO: 481 - protein, 9 aa, Homo sapiens
LVTGAAQGI

SEQ ID NO: 482 - protein, 9 aa, Homo sapiens
RAFAEALLL

SEQ ID NO: 483 - protein, 9 aa, Homo sapiens
VDWNLEAGV

SEQ ID NO: 484 - protein, 9 aa, Homo sapiens
KTLFIQCDV

SEQ ID NO: 485 - protein, 9 aa, Homo sapiens
KVVDHFGRL

SEQ ID NO: 486 - protein, 9 aa, Homo sapiens
DHFGRLDIL

SEQ ID NO: 487 - protein, 9 aa, Homo sapiens
KNWEKTLQI

SEQ ID NO: 488 - protein, 9 aa, Homo sapiens
GTYLGLDYM

SEQ ID NO: 489 - protein, 9 aa, Homo sapiens
IIINMSSLA

SEQ ID NO: 490 - protein, 9 aa, Homo sapiens
ICPGFVNTA

SEQ ID NO: 491 - protein, 9 aa, Homo sapiens
TLIEDDALN

SEQ ID NO: 492 - protein, 9 aa, Homo sapiens
ALVTGAAQG

SEQ ID NO: 493 - protein, 9 aa, Homo sapiens
NLEAGVQCK

SEQ ID NO: 494 - protein, 9 aa, Homo sapiens
YLGLDYMSK

SEQ ID NO: 495 - protein, 9 aa, Homo sapiens
AIMKITTSK

SEQ ID NO: 496 - protein, 9 aa, Homo sapiens
ALLLKGAKV

SEQ ID NO: 497 - protein, 9 aa, Homo sapiens
LLLKGAKVA

SEQ ID NO: 498 - protein, 9 aa, Homo sapiens
ILVNNAGVN

SEQ ID NO: 499 - protein, 9 aa, Homo sapiens
LVSVISGTY

SEQ ID NO: 500 - protein, 9 aa, Homo sapiens
PLIANGLIT

SEQ ID NO: 501 - protein, 9 aa, Homo sapiens
GLMPVAQQP

SEQ ID NO: 502 - protein, 9 aa, Homo sapiens
RLNAICPGF

SEQ ID NO: 503 - protein, 9 aa, Homo sapiens
AICPGFVNT

SEQ ID NO: 504 - protein, 9 aa, Homo sapiens
YIEYKDHIK

SEQ ID NO: 505 - protein, 9 aa, Homo sapiens
DALNGAIMK

SEQ ID NO: 506 - protein, 9 aa, Homo sapiens
KVALVTGAA

SEQ ID NO: 507 - protein, 9 aa, Homo sapiens
AFAEALLLK

SEQ ID NO: 508 - protein, 9 aa, Homo sapiens
LLKGAKVAL

SEQ ID NO: 509 - protein, 9 aa, Homo sapiens
LVNNAGVNN

SEQ ID NO: 510 - protein, 9 aa, Homo sapiens
SLAGLMPVA

SEQ ID NO: 511 - protein, 9 aa, Homo sapiens
NLMNSGVRL

SEQ ID NO: 512 - protein, 9 aa, Homo sapiens
ALVDWNLEA

SEQ ID NO: 513 - protein, 9 aa, Homo sapiens
GVQCKAALD

SEQ ID NO: 514 - protein, 9 aa, Homo sapiens
QQLRDTFRK

SEQ ID NO: 515 - protein, 9 aa, Homo sapiens
TLQINLVSV

SEQ ID NO: 516 - protein, 9 aa, Homo sapiens
GIIINMSSL

SEQ ID NO: 517 - protein, 9 aa, Homo sapiens
IIINMSSLA

SEQ ID NO: 518 - protein, 9 aa, Homo sapiens
QQPVYCASK

SEQ ID NO: 519 - protein, 9 aa, Homo sapiens
IVGFTRSAA

SEQ ID NO: 520 - protein, 9 aa, Homo sapiens
ALAANLMNS

SEQ ID NO: 521 - protein, 9 aa, Homo sapiens
GVRLNAICP

SEQ ID NO: 522 - protein, 9 aa, Homo sapiens
TLIEDDALN

SEQ ID NO: 523 - protein, 9 aa, Homo sapiens
HVNGKVALV

SEQ ID NO: 524 - protein, 9 aa, Homo sapiens
KVALVDWNL

SEQ ID NO: 525 - protein, 9 aa, Homo sapiens
DVADQQQLR

SEQ ID NO: 526 - protein, 9 aa, Homo sapiens
QLRDTFRKV

SEQ ID NO: 527 - protein, 9 aa, Homo sapiens
QINLVSVIS

SEQ ID NO: 528 - protein, 9 aa, Homo sapiens
SVISGTYLG

SEQ ID NO: 529 - protein, 9 aa, Homo sapiens
PVAQQPVYC

SEQ ID NO: 530 - protein, 9 aa, Homo sapiens
KHGIVGFTR

SEQ ID NO: 531 - protein, 9 aa, Homo sapiens
KDHIKDMIK

SEQ ID NO: 532 - protein, 9 aa, Homo sapiens
HIKDMIKYY

SEQ ID NO: 533 - protein, 9 aa, Homo sapiens
ILDPPLIAN

SEQ ID NO: 534 - protein, 9 aa, Homo sapiens
LIANGLITL

SEQ ID NO: 535 - protein, 9 aa, Homo sapiens
ALNGAIMKI

SEQ ID NO: 536 - protein, 9 aa, Homo sapiens
KITTSKGIH

SEQ ID NO: 537 - protein, 9 aa, Homo sapiens
STDAAVLSV

SEQ ID NO: 538 - protein, 9 aa, Homo sapiens
VTEGNRLLQ

SEQ ID NO: 539 - protein, 9 aa, Homo sapiens
STDSANEKP

SEQ ID NO: 540 - protein, 9 aa, Homo sapiens
RCTVSLTRY

SEQ ID NO: 541 - protein, 9 aa, Homo sapiens
KHFVSERKY

SEQ ID NO: 542 - protein, 9 aa, Homo sapiens
QLAELRAEI

SEQ ID NO: 543 - protein, 9 aa, Homo sapiens
CIIDKEVSL

SEQ ID NO: 544 - protein, 9 aa, Homo sapiens
VLSVPAVTL

SEQ ID NO: 545 - protein, 9 aa, Homo sapiens
ALIPREKKI

SEQ ID NO: 546 - protein, 9 aa, Homo sapiens
RLLQQKLSL

SEQ ID NO: 547 - protein, 9 aa, Homo sapiens
DLQRCTVSL

SEQ ID NO: 548 - protein, 9 aa, Homo sapiens
SLMAEMDKV

SEQ ID NO: 549 - protein, 9 aa, Homo sapiens
ILEEPSKAL

SEQ ID NO: 550 - protein, 9 aa, Homo sapiens
NLCPTRIEV

SEQ ID NO: 551 - protein, 9 aa, Homo sapiens
SLLPLLNAH

SEQ ID NO: 552 - protein, 9 aa, Homo sapiens
STDAAVLSV

SEQ ID NO: 553 - protein, 9 aa, Homo sapiens
NVKEKIYAV

SEQ ID NO: 554 - protein, 9 aa, Homo sapiens
VLQQFDFNV

SEQ ID NO: 555 - protein, 9 aa, Homo sapiens
HLEIKPDEL

SEQ ID NO: 556 - protein, 9 aa, Homo sapiens
SLTRYRVMI

SEQ ID NO: 557 - protein, 9 aa, Homo sapiens
KIKAAFAEL

SEQ ID NO: 558 - protein, 9 aa, Homo sapiens
SLGMKTPEA

SEQ ID NO: 559 - protein, 9 aa, Homo sapiens
AAVLSVPAV

SEQ ID NO: 560 - protein, 9 aa, Homo sapiens
SLDGNPKPI

SEQ ID NO: 561 - protein, 9 aa, Homo sapiens
MAEMQLAEL

SEQ ID NO: 562 - protein, 9 aa, Homo sapiens
KIYAVRSVV

SEQ ID NO: 563 - protein, 9 aa, Homo sapiens
SNNEIVLVL

SEQ ID NO: 564 - protein, 9 aa, Homo sapiens
SANEKPALI

SEQ ID NO: 565 - protein, 9 aa, Homo sapiens
SILEEPSKA

SEQ ID NO: 566 - protein, 9 aa, Homo sapiens
NIEKSVKDL

SEQ ID NO: 567 - protein, 9 aa, Homo sapiens
NLASQMAEM

SEQ ID NO: 568 - protein, 9 aa, Homo sapiens
KMVSSLPST

SEQ ID NO: 569 - protein, 9 aa, Homo sapiens
LLPLLNAHA

SEQ ID NO: 570 - protein, 9 aa, Homo sapiens
KSNNEIVLV

SEQ ID NO: 571 - protein, 9 aa, Homo sapiens
PLQPQPPQI

SEQ ID NO: 572 - protein, 9 aa, Homo sapiens
GVTEGNRLL

SEQ ID NO: 573 - protein, 9 aa, Homo sapiens
IIDKEVSLM

SEQ ID NO: 574 - protein, 9 aa, Homo sapiens
KKAEELKRL

SEQ ID NO: 575 - protein, 9 aa, Homo sapiens
ANPKMVSSL

SEQ ID NO: 576 - protein, 9 aa, Homo sapiens
GAKNQEASL

SEQ ID NO: 577 - protein, 9 aa, Homo sapiens
LSVPAVTLV

SEQ ID NO: 578 - protein, 9 aa, Homo sapiens
FVDGSAIQV

SEQ ID NO: 579 - protein, 9 aa, Homo sapiens
ALRGVTEGN

SEQ ID NO: 580 - protein, 9 aa, Homo sapiens
LLQQKLSLD

SEQ ID NO: 581 - protein, 9 aa, Homo sapiens
GTTERSDGL

SEQ ID NO: 582 - protein, 9 aa, Homo sapiens
LRAEIKHFV

SEQ ID NO: 583 - protein, 9 aa, Homo sapiens
DIEQLKAQI

SEQ ID NO: 584 - protein, 9 aa, Homo sapiens
LLNAHAATS

SEQ ID NO: 585 - protein, 9 aa, Homo sapiens
AELNTHVNV

SEQ ID NO: 586 - protein, 9 aa, Homo sapiens
AFAELHNCI

SEQ ID NO: 587 - protein, 9 aa, Homo sapiens
KVKEEAMEI

SEQ ID NO: 588 - protein, 9 aa, Homo sapiens
ILTARQKKA

SEQ ID NO: 589 - protein, 9 aa, Homo sapiens
KAARFSCDI

SEQ ID NO: 590 - protein, 9 aa, Homo sapiens
IMLCGEITH

SEQ ID NO: 591 - protein, 9 aa, Homo sapiens
MLCGEITHP

SEQ ID NO: 592 - protein, 9 aa, Homo sapiens
PLLNAHAAT

SEQ ID NO: 593 - protein, 9 aa, Homo sapiens
EARPFRGSV

SEQ ID NO: 594 - protein, 9 aa, Homo sapiens
AVRSVVPNK

SEQ ID NO: 595 - protein, 9 aa, Homo sapiens
KLSLDGNPK

SEQ ID NO: 596 - protein, 9 aa, Homo sapiens
KIYAVRSVV

SEQ ID NO: 597 - protein, 9 aa, Homo sapiens
EIKPDELAK

SEQ ID NO: 598 - protein, 9 aa, Homo sapiens
ELNTHVNVK

SEQ ID NO: 599 - protein, 9 aa, Homo sapiens
RLTNLASQM

SEQ ID NO: 600 - protein, 9 aa, Homo sapiens
AVLSVPAVT

SEQ ID NO: 601 - protein, 9 aa, Homo sapiens
RKYDEELGK

SEQ ID NO: 602 - protein, 9 aa, Homo sapiens
LLNAHAATS

SEQ ID NO: 603 - protein, 9 aa, Homo sapiens
RPKNKGGAK

SEQ ID NO: 604 - protein, 9 aa, Homo sapiens
ALIPREKKI

SEQ ID NO: 605 - protein, 9 aa, Homo sapiens
RLLQQKLSL

SEQ ID NO: 606 - protein, 9 aa, Homo sapiens
ELHNCIIDK

SEQ ID NO: 607 - protein, 9 aa, Homo sapiens
EILTARQKK

SEQ ID NO: 608 - protein, 9 aa, Homo sapiens
SLLPLLNAH

SEQ ID NO: 609 - protein, 9 aa, Homo sapiens
RLNGPAKSQ

SEQ ID NO: 610 - protein, 9 aa, Homo sapiens
VLSVPAVTL

SEQ ID NO: 611 - protein, 9 aa, Homo sapiens
SVPAVTLVA

SEQ ID NO: 612 - protein, 9 aa, Homo sapiens
SLTRYRVMI

SEQ ID NO: 613 - protein, 9 aa, Homo sapiens
RVMIKEEVD

SEQ ID NO: 614 - protein, 9 aa, Homo sapiens
KEEVDSSVK

SEQ ID NO: 615 - protein, 9 aa, Homo sapiens
SVKKIKAAF

SEQ ID NO: 616 - protein, 9 aa, Homo sapiens
MEILTARQK

SEQ ID NO: 617 - protein, 9 aa, Homo sapiens
EVSTDAAVL

SEQ ID NO: 618 - protein, 9 aa, Homo sapiens
KVERPEAGP

SEQ ID NO: 619 - protein, 9 aa, Homo sapiens
ALRGVTEGN

SEQ ID NO: 620 - protein, 9 aa, Homo sapiens
DLQRCTVSL

SEQ ID NO: 621 - protein, 9 aa, Homo sapiens
CIIDKEVSL

SEQ ID NO: 622 - protein, 9 aa, Homo sapiens
KVKEEAMEI

SEQ ID NO: 623 - protein, 9 aa, Homo sapiens
ELRAEIKHF

SEQ ID NO: 624 - protein, 9 aa, Homo sapiens
PLGKGNSRH

SEQ ID NO: 625 - protein, 9 aa, Homo sapiens
FVDGSAIQV

SEQ ID NO: 626 - protein, 9 aa, Homo sapiens
ISILEEPSK

SEQ ID NO: 627 - protein, 9 aa, Homo sapiens
AEQPCNPSK

SEQ ID NO: 628 - protein, 9 aa, Homo sapiens
KKRGPNIEK

SEQ ID NO: 629 - protein, 9 aa, Homo sapiens
GPNIEKSVK

SEQ ID NO: 630 - protein, 9 aa, Homo sapiens
QLAELRAEI

SEQ ID NO: 631 - protein, 9 aa, Homo sapiens
MVSSLPSTA

SEQ ID NO: 632 - protein, 9 aa, Homo sapiens
NNRLNGPAK

SEQ ID NO: 633 - protein, 9 aa, Homo sapiens
HVNVKEKIY

SEQ ID NO: 634 - protein, 9 aa, Homo sapiens
SVVPNKSNN

SEQ ID NO: 635 - protein, 9 aa, Homo sapiens
EIVLVLQQF

SEQ ID NO: 636 - protein, 9 aa, Homo sapiens
QQFDFNVDK

SEQ ID NO: 637 - protein, 9 aa, Homo sapiens
VLKEWNMTG

SEQ ID NO: 638 - protein, 9 aa, Homo sapiens
KNNKRKRSK

SEQ ID NO: 639 - protein, 9 aa, Homo sapiens
NKRKRSKSK

SEQ ID NO: 640 - protein, 9 aa, Homo sapiens
PLQPQPPQI

SEQ ID NO: 641 - protein, 9 aa, Homo sapiens
KIKAAFAEL

SEQ ID NO: 642 - protein, 9 aa, Homo sapiens
PLLNAHAAT

SEQ ID NO: 643 - protein, 9 aa, Homo sapiens
QRRRFNPQY

SEQ ID NO: 644 - protein, 9 aa, Homo sapiens
PEAPAHSEK

SEQ ID NO: 645 - protein, 9 aa, Homo sapiens
RPFRGSVGR

SEQ ID NO: 646 - protein, 9 aa, Homo sapiens
RVSQCNLCP

SEQ ID NO: 647 - protein, 9 aa, Homo sapiens
DGSAIQVLK

SEQ ID NO: 648 - protein, 9 aa, Homo sapiens
KPALIPREK

SEQ ID NO: 649 - protein, 9 aa, Homo sapiens
SILEEPSKA

SEQ ID NO: 650 - protein, 9 aa, Homo sapiens
SKALRGVTE

SEQ ID NO: 651 - protein, 9 aa, Homo sapiens
EGNRLLQQK

SEQ ID NO: 652 - protein, 9 aa, Homo sapiens
GLQWSAEQP

SEQ ID NO: 653 - protein, 9 aa, Homo sapiens
IKPDELAKK

SEQ ID NO: 654 - protein, 9 aa, Homo sapiens
LTRYRVMIK

SEQ ID NO: 655 - protein, 9 aa, Homo sapiens
LMAEMDKVK

SEQ ID NO: 656 - protein, 9 aa, Homo sapiens
ILTARQKKA

SEQ ID NO: 657 - protein, 9 aa, Homo sapiens
LAELRAEIK

SEQ ID NO: 658 - protein, 9 aa, Homo sapiens
EIKHFVSER

SEQ ID NO: 659 - protein, 9 aa, Homo sapiens
QLKAQIMLC

SEQ ID NO: 660 - protein, 9 aa, Homo sapiens
GNEAEPLGK

SEQ ID NO: 661 - protein, 9 aa, Homo sapiens
GTLGRMHYY

SEQ ID NO: 662 - protein, 9 aa, Homo sapiens
ANPESFGLY

SEQ ID NO: 663 - protein, 9 aa, Homo sapiens
LLSNSLAAY

SEQ ID NO: 664 - protein, 9 aa, Homo sapiens
TGTLGRMHY

SEQ ID NO: 665 - protein, 9 aa, Homo sapiens
GLLLTLCLL

SEQ ID NO: 666 - protein, 9 aa, Homo sapiens
LLLTLCLLV

SEQ ID NO: 667 - protein, 9 aa, Homo sapiens
TLCLLVISI

SEQ ID NO: 668 - protein, 9 aa, Homo sapiens
LLTLCLLVI

SEQ ID NO: 669 - protein, 9 aa, Homo sapiens
VCFGLLLTL

SEQ ID NO: 670 - protein, 9 aa, Homo sapiens
VLGVCFGLL

SEQ ID NO: 671 - protein, 9 aa, Homo sapiens
RLEERERIL

SEQ ID NO: 672 - protein, 9 aa, Homo sapiens
DMELLSNSL

SEQ ID NO: 673 - protein, 9 aa, Homo sapiens
FVLGVCFGL

SEQ ID NO: 674 - protein, 9 aa, Homo sapiens
LLVISISWA

SEQ ID NO: 675 - protein, 9 aa, Homo sapiens
TLPGPELSA

SEQ ID NO: 676 - protein, 9 aa, Homo sapiens
LLSNSLAAY

SEQ ID NO: 677 - protein, 9 aa, Homo sapiens
FGLYFVLGV

SEQ ID NO: 678 - protein, 9 aa, Homo sapiens
RANPESFGL

SEQ ID NO: 679 - protein, 9 aa, Homo sapiens
RILREIWRT

SEQ ID NO: 680 - protein, 9 aa, Homo sapiens
LLGTGTLGP

SEQ ID NO: 681 - protein, 9 aa, Homo sapiens
FGLLLTLCL

SEQ ID NO: 682 - protein, 9 aa, Homo sapiens
TRLGPDDTL

SEQ ID NO: 683 - protein, 9 aa, Homo sapiens
LSAEPDGPL

SEQ ID NO: 684 - protein, 9 aa, Homo sapiens
NVFTSAEEL

SEQ ID NO: 685 - protein, 9 aa, Homo sapiens
GTLGPSPTA

SEQ ID NO: 686 - protein, 9 aa, Homo sapiens
TLGPSPTAT

SEQ ID NO: 687 - protein, 9 aa, Homo sapiens
SLAAYAHIR

SEQ ID NO: 688 - protein, 9 aa, Homo sapiens
AEPDGPLNV

SEQ ID NO: 689 - protein, 9 aa, Homo sapiens
ILREIWRTG

SEQ ID NO: 690 - protein, 9 aa, Homo sapiens
LLSNSLAAY

SEQ ID NO: 691 - protein, 9 aa, Homo sapiens
SLAAYAHIR

SEQ ID NO: 692 - protein, 9 aa, Homo sapiens
HIRANPESF

SEQ ID NO: 693 - protein, 9 aa, Homo sapiens
GLYFVLGVC

SEQ ID NO: 694 - protein, 9 aa, Homo sapiens
ILREIWRTG

SEQ ID NO: 695 - protein, 9 aa, Homo sapiens
LLTLCLLVI

SEQ ID NO: 696 - protein, 9 aa, Homo sapiens
RLGPDDTLP

SEQ ID NO: 697 - protein, 9 aa, Homo sapiens
DLLGTGTLG

SEQ ID NO: 698 - protein, 9 aa, Homo sapiens
TLPGPELSA

SEQ ID NO: 699 - protein, 9 aa, Homo sapiens
RLEERERIL

SEQ ID NO: 700 - protein, 9 aa, Homo sapiens
RILREIWRT

SEQ ID NO: 701 - protein, 9 aa, Homo sapiens
ELLSNSLAA

SEQ ID NO: 702 - protein, 9 aa, Homo sapiens
VISISWAPR

SEQ ID NO: 703 - protein, 9 aa, Homo sapiens
RPRPRGPAQ

SEQ ID NO: 704 - protein, 9 aa, Homo sapiens
PRPRGPAQR

SEQ ID NO: 705 - protein, 9 aa, Homo sapiens
RPRGPAQRR

SEQ ID NO: 706 - protein, 9 aa, Homo sapiens
RRDPRSSTL

SEQ ID NO: 707 - protein, 9 aa, Homo sapiens
TVTRLGPDD

SEQ ID NO: 708 - protein, 9 aa, Homo sapiens
TLGPSPTAT

SEQ ID NO: 709 - protein, 9 aa, Homo sapiens
FLHSVGVKL

SEQ ID NO: 710 - protein, 9 aa, Homo sapiens
ALPGELRGA

SEQ ID NO: 711 - protein, 9 aa, Homo sapiens
MEPDFLHSV

SEQ ID NO: 712 - protein, 9 aa, Homo sapiens
ALGLQTQGA

SEQ ID NO: 713 - protein, 9 aa, Homo sapiens
GLQTQGAEM

SEQ ID NO: 714 - protein, 9 aa, Homo sapiens
EAAPGARAL

SEQ ID NO: 715 - protein, 9 aa, Homo sapiens
AMAQSGGAA

SEQ ID NO: 716 - protein, 9 aa, Homo sapiens
GAAFWGSAL

SEQ ID NO: 717 - protein, 9 aa, Homo sapiens
AFWGSALGL

SEQ ID NO: 718 - protein, 9 aa, Homo sapiens
MLAAGPPTR

SEQ ID NO: 719 - protein, 9 aa, Homo sapiens
SVGVKLPHT

SEQ ID NO: 720 - protein, 9 aa, Homo sapiens
KLPHTPPNT

SEQ ID NO: 721 - protein, 9 aa, Homo sapiens
RRDPVPVEV

SEQ ID NO: 722 - protein, 9 aa, Homo sapiens
MLAAGPPTR

SEQ ID NO: 723 - protein, 9 aa, Homo sapiens
VGKPSRVQK

SEQ ID NO: 724 - protein, 9 aa, Homo sapiens
RQSGAPGSK

SEQ ID NO: 725 - protein, 9 aa, Homo sapiens
ELRGAEVPG

SEQ ID NO: 726 - protein, 9 aa, Homo sapiens
FLHSVGVKL

SEQ ID NO: 727 - protein, 9 aa, Homo sapiens
DPVPVEVGK

SEQ ID NO: 728 - protein, 9 aa, Homo sapiens
PVEVGKPSR

SEQ ID NO: 729 - protein, 9 aa, Homo sapiens
RVQKAEAMA

SEQ ID NO: 730 - protein, 9 aa, Homo sapiens
EVPGEAAPG

SEQ ID NO: 731 - protein, 9 aa, Homo sapiens
DFLHSVGVK

SEQ ID NO: 732 - protein, 9 aa, Homo sapiens
ALPDLGNRQ

SEQ ID NO: 733 - protein, 9 aa, Homo sapiens
GLQTQGAEM

SEQ ID NO: 734 - protein, 9 aa, Homo sapiens
DLGNRQSGA

SEQ ID NO: 735 - DNA, 1926 bp, Homo sapiens
  CDS (1)..(1926)
atggcattatcactggaagaattcgtccactcccttgacctcaggaccctacccagggttctagaaatccaggcaggcatctatcttgaaggctctatttatgaaatgtttggaaatgaatgctgtttttcaacaggagaagtgattaaaattactggtctcaaagttaagaagatcatagctgaaatttgtgagcagattgaaggttgtgagtctctacagccatttgaactgcctatgaattttccaggtctttttaagattgtggctgataaaactccataccttactatggaagaaatcacaaggaccattcatattggaccaagtagactagggcatccttgcttctatcatcagaaggatataaaactagagaacctcatcataaagcagggtgagcaaatcatgctcaactcagttgaagagattgatggagaaataatggtgagctgtgcagtagcaaggaatcatcaaactcactcatttaatttgcctttgtcacaagaaggagaattctacgagtgtgaagatgaacgtatttacactctaaaggagattgttgaatggaagattcctaagaacagaacaagaactgtaaaccttacagatttttcaaataagtgggactcaacgaatccatttcctaaagacttttatggtaccctgattctcaagcctgtttatgaaattcaaggtgtgatgaaatttcgaaaagatataatccgcatcctccccagtctagatgtcgaagtcaaagacatcactgattcttacgatgctaactggtttcttcagctgttatcaacagaagatctttttgaaatgactagtaaagagttccccatagtgactgaagtcatagaagcacctgaaggaaaccacctgccccaaagcattttacagcctgggaaaaccattgtgatccacaaaaagtaccaggcatcaagaatcttagcttcagaaattagaagcaattttcctaaaagacacttcttgatccccactagctataaaggcaagttcaagcggcgaccgagggagttcccaacggcctatgacctagagatcgctaagagtgaaaaggagcctcttcacgtggtggccaccaaagcgtttcattcccctcatgacaagctgtcatccgtatctgttggggaccagtttctggtgcatcagtcagagacgactgaagtcctctgtgagggaataaaaaaagtggtgaatgttctggcctgtgaaaaaatcctcaaaaagtcctatgaggctgcgctgctccctttgtacatggaaggaggttttgtagaggtgattcatgataagaaacagtacccgatttctgagctctgtaaacagttccgtttgcccttcaatgtgaaggtgtctgtcagggatctttccattgaagaggacgtgttggctgccacaccaggactgcagttggaggaggacattacagactcttacctactcataagtgactttgccaaccccacggagtgctgggaaattcctgtgggccgcttgaatatgactgttcagttagttagtaatttctctagggatgcagaaccatttctagtcaggactctggtagaagagatcactgaagagcaatattacatgatgcggagatatgaaagctcagcctcacatcccccacctcgccctccgaaacacccctcagtagaggaaacaaagttaaccctgctaaccttagcagaagaaaggacggtagacctgcccaagtctcccaagcgtcatcacgtagacataaccaagaaacttcacccaaatcaagctggcctggattcaaaagtactgattggtagtcagaatgatttggtggatgaagagaaagaaaggagcaaccgtggggccacagcaatagcagaaacattcaaaaatgaaaaacatcaaaaataa

SEQ ID NO: 736 - protein, 641 aa, Homo sapiens
MALSLEEFVHSLDLRTLPRVLEIQAGIYLEGSIYEMFGNECCFSTGEVIKITGLKVKKIIAEICEQIEGCESLQPFELPMNFPGLFKIVADKTPYLTMEEITRTIHIGPSRLGHPCFYHQKDIKLENLIIKQGEQIMLNSVEEIDGEIMVSCAVARNHQTHSFNLPLSQEGEFYECEDERIYTLKEIVEWKIPKNRTRTVNLTDFSNKWDSTNPFPKDFYGTLILKPVYEIQGVMKFRKDIIRILPSLDVEVKDITDSYDANWFLQLLSTEDLFEMTSKEFPIVTEVIEAPEGNHLPQSILQPGKTIVIHKKYQASRILASEIRSNFPKRHFLIPTSYKGKFKRRPREFPTAYDLEIAKSEKEPLHVVATKAFHSPHDKLSSVSVGDQFLVHQSETTEVLCEGIKKVVNVLACEKILKKSYEAALLPLYMEGGFVEVIHDKKQYPISELCKQFRLPFNVKVSVRDLSIEEDVLAATPGLQLEEDITDSYLLISDFANPTECWEIPVGRLNMTVQLVSNFSRDAEPFLVRTLVEEITEEQYYMMRRYESSASHPPPRPPKHPSVEETKLTLLTLAEERTVDLPKSPKRHHVDITKKLHPNQAGLDSKVLIGSQNDLVDEEKERSNRGATAIAETFKNEKHQK

The invention claimed is:

1. A method for isolating, identifying or characterizing suppressive and/or regulatory human T cells obtained from human blood, comprising:
   (a) contacting the human blood with one or more antibodies or antibody fragments that specifically bind to CD4, CD25 and/or CD127 on the T cells in order to isolate cells obtained from human blood;
   (b) contacting the cells obtained from human blood with one or more antibodies or antibody fragments that specifically bind to one or more marker proteins comprising a sequence consisting of SEQ ID NO: 8; and
   (c) isolating, identifying or characterizing antibody-bound or antibody-fragment-bound cells, wherein the antibody-bound or antibody-fragment-bound cells are suppressive and/or regulatory human T cells from the human blood.

2. A method for isolating, identifying or characterizing suppressive and/or regulatory human T cells obtained from human blood, comprising:

(a) contacting the cells obtained from human blood with one or more antibodies or antibody fragments that specifically bind to one or more marker proteins comprising a sequence consisting of SEQ ID NO: 8;
(b) isolating, identifying or characterizing antibody-bound or antibody-fragment-bound cells, wherein the antibody-bound or antibody-fragment-bound cells are suppressive and/or regulatory human T cells from the human blood; and
(c) assaying for FOXP3 expression.

* * * * *